United States Patent 10,407,724 (METHODS AND COMPOSITIONS FOR SCREENING AND TREATING DEVELOPMENTAL DISORDERS) - sequence listing, part 31

SEQ ID NO: 628 - DNA, 1633948 bp, Homo sapiens
  misc_feature (90903)..(190902): n is a, c, g, or t
tgatttaaaacacaaattatttgcttatttttcacactaataacaaagaatatagacactatatatgttccaatcacattgatcatgcagaaaataaatattctttggtactggttttcctttgatcacaaatagatatgagggcaaaatgtcttatcacttatttacaaataactgatggccaaaatggataattgtcatgatagaagttattgacactggctgggtggggtggctcatgcttgtaatcctagcactttgggagaccgagaaaggtgggatcacctgaggtcaggagtttgagaccagcctggccaacatgtagaaaccctgtctctacataaaaaaaaataaaaaataaataaacactctttggttttggtggtgggcacctgtaattccagttactttgggaggctgaggcaggaaagaagttattgatacaaatatttgcaaaaataaaaagttatttgatacccacaaataattccaaagtatgtccatgtgctaatttgtaaataggaaggaagttcttattttgaaacttgcagcctggaaaatatttataaggttgttatgacattgataactggagtacttcctatatcaacttactagaattttggagactgactttaaaatataataaaaagggaaagacagggaattgaacttccttctcatgttttttacaaattttacagggagccagtctcatttatgtaatcacagatttattttacaagtttggacttgcaaaaatatgccaaaatttgaatgccttacccatttttttgggaagcagctaaaatatgtaatgcactgaccttttaatgttcactttgattggttaatggttacacctttacagctcagtcagattgtaaacaaggggacaaaactgaatatataaggtcagagaagtatagtgacaaaatttatgaacccctatacatttcctatgaataaaaaatgattaaaattcatacgtttgctttttaaatatatacataagaaacatcaaaaattaattcaaagcatatattagcaaatatattcttaattttgtcttgaataaccttctttaggtgtgcctttttctacaaagttatgtcttcattaaacatttttcaaattattagtattattatttttaactgatgcttcatattttatttcccctctgctctcccatcccacctttggtgatggttgtgcccatctgagcatttcggggcacatgaccgtaagtaaatcttgagagaggagtggaattattgtctaaacactaacagaaggggattacctgtaaggatagcataactgttgtgcaggaacagaagctgcccagatcttcttggtggagagtgcatagaaaaaagacttagaattatggaacatctgtccccccaaccaccctttcccacccatcccccaaacccccactcccaccctattccccgcccaattaatagtgttaacaaaaggttaatctaacttttttttttttttttgacggagtcttgctcagtcgcccaggctggagtgcagtggcgcgatctcagctcactgcaagctccacctcccgggttcacgccattctcctgcctcagcctcccaagtagctgagactgcaggcgcccgccacgacgcccaactaattttttgtattttttagtacagacggggtttcaccgtgttagccaggatggtctccatctcctgaccttgtgatccgcccgcctcggcctcccaaagtgctgggattacaggcgtgagccaccgcgcccggcttccagaatataaaaaatgagttccatgacgacagggccctcactgagctggcaggcccctccatggatcaccggcaccaaggcgctgtccaaatcattcatggactgcgagggaaggggctggccgctgctccctgcttgatagccagcctgatctgagtcaagtgttacacgtagtcccagtttggtcattccatcctccttcagaagcttcaggagcaaggcaaaaagccttggcaacatgctcagtcaatctactgtgatccgtaggatcactgaggcaattgtgccggtcatcgtttccttgtaatcccagcactaggatttctaggaaatcctgggaatcgttttctagaaaaaacacctctgtccatatgatgacttttccatttgctttgtattctgatccgtggaatatcttcacatttgttatagtctccatggacttcccatctataggacttagacacccttgctaacgttcttgtcatcatccacccaccggatgtgcatgcgctcctggggatcctccgcgtctgccttcccacaggtgatgctgaagtccctcgtctctagcagtgcctgcctcgaggaatccatgttctctgcagtgatctggaccataacgccatcttccacaatactggacttggcaaggtatccagaagaggatttcagagcgccaccgaacacaaaaaaactgctttgagtttgcatatagttacagtagtactgaaaaatcctcgcaatttaggtttttgttttcagttttctctgttttctagtgcataatgacttaataaatattcatttaacaaaaattgaaatctcaaaggtacatataaataaacaatataaataaccatccttattacagttaactttgtgctttaaaaaaaaaaggcatccaaagaaagacagacgtattcatgcaataaaatcttagcaatccctgcaatagtttaacagaattatcagccctcccatcttagtctggacagaatgaaaaaaaaattagttctctcgtgttattctttgagctccaactaggaaaaattactgaaaacagctggacgttacaactgttttgggcagagaagtcacactgttcaggaggaccccatggtagaaactgttttaaaaaagttctttttacttgaaattacacaagaaagcagaaaatgacattgcaaaaaggaaaaaagtataggcaggaacattgttacagaagccaggtgacaatgagaagtagagagtagaaagcaatcaacccttttgaccactgagaatgaggatagtagaaattcaatggctcatggatagcaatagtcactcacatgtcaataacagggattctgaagagtcagacttatgcatacacagagcatctctaccacatgcatgaattatgtgtgagtttggtgataatgaagagagacaaactgctgcatcaactaatatactctgggagtgaagagcaggataaaaaaaaaactgtagagaccactactctaggtcatttaagtattttaaggagaaaaaaataacataatagaagaaagtgataactatctggagtggtgggatgggtggcttctgacacagctcccatgtttctgattccacctcccgatatcttgtattatctccccttcttgagtatgagctggacctggtgccttgctggtaagagacagaattcaacaaaagtaatgcggtgttacttccttggttagctaacaaggaactatgtcttgccccttgctagccacccccaactcttgctggcattccctcttgccctctcgcttgcttgctttgataaagagagttgccatgttgtgtgatgctttgtggagagacccacgtgacaaggaaccaagggagtttacagcacaacacctggcacaaaactaaagccaacaactatgtgagtgagtctgcaaataaatcattccctgtccagccttaagatgactgcagacttttaaaagagtgagagtcagaggccacagctaatccacatgtggattcccaccaacaaaaattgaaataatgtgtgttttaaaatgctaagtttgggggtgatatgttacatataaatagataaataataaagatggtttggcatggagataatgacagaaaggaattcgactattttaatagtccaatgaagaggtatgaaagatctgaatttggatggtagcagtgtgaatgatgtaaaagataaatgtgagattctataaggtaagattttataggacctaccaataataggggtgagaggaggatagagagatgggagagagaaagggagggggaaagagagaaaaggagagggagaagtggtaaatgaacaagatttttagttcaagtcagtaggaaaaccactggcagagttgttttatttaagcattaacaattactttccgagcaactgtgatgtgtaagacattatgttatctgtactagacactgagatgaaccctcaaaatggtgatgccctcaaaatggtatagtgcaaagtagaatgttgtgaaatttttcctaatggagaaattcatccaattagcatttgaggaaaggtatatgtgagttggactttggatagtaacatacagagattagcattagaaaggaagcaaaatatttcattagacatataaagaagtcaatagtttattttcactagattgcaagcatatgaaaaagacaacaggaaaatgtgtctcaattgtcagcctaaatttaacatcttattctgtagtgaaatcacaggacaagtaaatagatgtcttgcacttaggacaaattatttaagtttgttgaagaaatgagatgattgattttatttttaagtaataagtaatgtgagaacatctgcaatcagtaagatttatgtagatccaggctcaacaaactactgccgatgggccaaatctagtctgcagctcattcatgtaaacaaagtttcactggaatatagccgtcctcattcattacgtaatgtctatggctttgacagagactgtgccacctgcaaagtcaaaaatatttactatctgtccctggacaggaaacgcttctcaatccctggtctacatcataaaatggatttgagtggagagaaagaaaaaaaactcattaaaacatatggggtgttactgccttaaacaagtagtatactaacaatagaaatggaaaggaaaagttggagtgtgcatgtgggtatgcatctgtgtgcatttgtgtgtatgtgatgaaaactgtttaaatgcagggtacaatatagaagaggaggccatcgtggtgcttagatggctctgaattgacagtctcctccgttaatatttaagtgcaattttggaggaataagtctttccactcaactcttaagtggtttaatcaactggccatatttttttcctaatggttagaaaggataagttactcagaaggaaaagtagtactgattgagaaagaattataatggaaggtggggggtgattgcatacttctaggaaagctggagggaacagctaaaaaacagtatgatactgaacacttggatgaaagcatgagtgaaagcaggtgagagcagccctaaaaggacgccagtttgcaccaaaagtaaacactggttttcatgctgcctcttgtatatatgtatcaaaagatactggtacttaatgtataaattagaatattaacttttaaaatatgaattgaacttatatggggtttaaaaaaatcaattatttaaaaacatcaccaggttccttttgttgtttaaattctctcctgatagaactaaataggggtctcttaaacagggttcaagaagcagaaacatacataatggtactcaggattcaatgcattaaagattaatattccttgaattagaagagccgaactaagtatccaaacaccagatataggtctagaatagcagatacatctaagtaggtttcaactgtctaagggcacatgcctggtgcagggacatgaacaaattgtgagtaaacagggataaaagccctatgagggatgtttaacattgaaatgtataaagtttttatttaatcacaaagttttctatattggctaaaattttataatgataatgaattattcatgtgaaaattaaaaactgttttttttgtatttttaaagaaaaaagcacaaatacacccatagaacactgtgaaatattatctttcacaatgtacaccaggccaggaaattattgggctaatttgagtcttcaacaaaattttactttgtgaagaaataagacaatgctggagggaccaaggttttcatttgcctgtgctccttctgatgccatctttactctccaggtgaaaggatgtttctgagatcaatattcctctcctttgatagttaccttcttttaaaacctactgaacactgacttactcagctccactctattcttccccgtttcctctgggtcctttgataatagatgctggtatccctgtctgtcattcactcctatatggttctcaggatttgtttgctgttcctccctctgttaacctgagccttgcgggccaaagtaaattactctcccagcaccttttatacagagtggtccatagtagttttcctgacacctatgttattacacatttctctccaagaacatctctaaagctttatgatttatacatttgagttaccttagaccaattgacctaaacacaagatatgctgtcacattttaagctgcttcctcagaatatgttggttgaaatctactgcctctcccttgtccagggtttctaaatacccgtagggtagcttctcaataatatatattactaatagctcagaatgattattatactaacaagaactttttactttcattactgtgtcagaggactcggaatatcattagcaaaacctgtttagaacagccatcttaaatccttgttgaaccaattccagcatgcttttaatttaagtaatcctggcgccgtggctcatgcctgtaatccaatcactttgggaggccgaggcaggcagatcatgaggtcaggagatccagaccttcctggccaacatggtgaaaccccatctctactaaaaatacaaaaatagttgggcatggtggcatgtgcctgtaatcccagctactcaagaggctgaggcaggtgaatctcttgaacccaggaggcagaggttgcagtgagctgagatcgcgccactgcactccagcctggtgacagagtgagaccccatctcaaaaaaaaaaaaaaaaaaaaaaaagaaatcttgagtagtacattccttcccaagatgagcatgcaaacaaagataacatgactttttattctatatgtacgtttgaaagatctctttagtcctttaaaaacttcatgagatgtataattttataaatattgagatgctttgggaaaaatattgaagaaaggccatttgattaggcataaagcacttaaagtgaatgccaagaaagttgcataggtcaaaataggtccacaaaaatgtatagattaatgaaccttccaatgtgaactgactgtttctctgagtgtcttttataattatgggtgaaggctgaggattgggcctggcccagatatggattaggggtaaaataagcagtggcacacaaaagatattttccctgaggcatattgactgaattattgtgatatatgcaagaatgaggagttattccagaagatttcaagagacagaataaaatcttcaagagtatcacagcaactgggagacaaactcattgcaaagaagagagcctgccccaaaagcatggccaactcccttgttcaacacatttctaagattttgaagctgaatagggtgaaatgctaaagggctaagcccaatacccctgaaattaaaatttaatctccaacaacattttttgagactaatgagaagtagttcctaccagctctcaatcaaaagctcaaaaggaacatacttcagaaacagagataagccaaagatgccagtcttactgaaactaaaactgaatcctgactgctccaatatctgattgtattggtaatgactttctcccaacactatctgcttaatagagaaaagtgggaatacattctaaaactactattaccagaatactttattattcttttatacacaatgtccagcatgatacaaaaaacgtctagatatgtgaagtggcaaaaattgtattaatcaaaacacatgtgcacaataagcgcagctcactgattcacagttcagaatttagcagacaaatttagaatgaccgttgctaatataataaaagtaggcaaactggatgaaatgatggagattgcagcaaagatttaaatatctataaaaagtcacacagatattctaaaacagaaacataataattgaacttatgtcactgaataggcttgctttagaataaatgtagtaaaacaagttaacctgaaaagagattcatagaaataatataaattgatctatagaaataatctcaactgaagagatttaataaagcagaacaaaaaagacataaggcactgtcacaacatctactataactaaactggacataaagacaagtgagagagaatggagaagaagcaatatcggaagagccgttggtcaaaaattttgtaaaattgataaagaatatcaacctacttgcaagaaacttaacaaaacctaaggaatataatacaaataaaactttacctatgcagattataagctgctgaaccaaaacaaaactctcaaaagtaagtaaaagagcacaaataagtattccaacaaaaacaatagaagctggagacaatgaaatggcattttaacatgctgaggggcaaatttgccagtctaaaatttaataaccagtgaaaaagcacataaaagtgaagcgcagtaaaatatattcagacaagtaattgttgagagaatgtttgcctaggagaactgaactacagaaatactaaggaaagttcttcagactaagaaaaaattatcccagagagaagcatacaattagaggaagcaatgaaattaactgaaataaaagccttaaaatattggcacaagaagttctaaagatctgagtaagttctgtatgtattatagaaactacatttatgattaacacattttacacacacacacacacacaattccaaccacatgtggattacctggtgaatccttaccaaaacttaaggaactaattgaactagtcttacacaagcattttcaggaaataatacaaaagaaagaacactttaatttttttgtgggaagccagtaatcattgatacaaaaatctgaaagatattaaagaaaagtaatttataaagaatattcaccatgaaaataaacctgagaagtaaggataaatataattaacttgtcttttacaaagtttaaatgttgaataaaatatatgacaaagagtgggagtagctaaatagtgttcaactgctctaaggtccttacattgttggagaagtggaaaaagtacgaacatacttcagaaatagtagtccacaatagttgagaataaatattatatcctctaggataactaaggtacttaaggtagtccacaatagtctagaataaatattctgtaggataactaaaagtactaaaaaggaattacaagtattttaataaaatgaaaaataaataattattctaaaaatggaaaaaaggccaggcgaagtggctcctgcctgtaatcccagcactttgggagtccgaggcgggtggatcacaaggtcaggagttccagaccagcctgaccaacatggtgaaaccccatctctactaaaaaatacaaaaattagccaggcgtggtggcgcatgcctgtaatctcagctactcaggaggctgaggcaggagaatcacttgaacccaagaggcggaggctgcagtgagctgagatggcaccactgcactccagcaggggcaacagagcgattaaaaaaaaaaaagccaaaaaaggaaataagaataaaaaaagatagtacaaatataaaaatattaaatccagaatttgaaagattaaatccagaattttaatacagaagattgtttcagaagattgtttcagaagatgtggaataactaccactcttatagactgttgtgtgaatgtgaatctgaacaaccatcttgaaaattcttttggcgagatctactgaagttaaatgtttgcataccttttgacccagcaattccactcctgggtatatatactcaagatcaatgagtacttcagtctaacaaaagatatatataagatattcaattagcattatttatagtagcccaaaattagaaacagatgaatcatccaataacacagttatatattcataaaatggaatacccctattaaaattataaagtatgaactataggtatatacaagaatctcataaattttgaaaacctaatattgaataaaatcagccatatgcaggagcatatatactgcatgatactatttttatgaagctcattaacagcctattaacattaattcattaatggaatgaatctatataaatagaggtcagtataggagttatctttttttgggttgtagttgactgagttggcaagaagaaggtttatggggtatttgtaagatttttttttttttggaggtggagtctctctctcgtcacccaggctggagtgcagtggcacaatctgggttcactgcaacctctgtctcctgggttcaagcaattcttctatctcagcctcccaagtagctgggattacaggtgcccgccaccacacccagctaatttttgcatttttagtagagacggggtttcatcaggctggccaggctggtcttgaactcctaaactcaggtgatccacccgcctcggcctcccaaagtgctggaattacaggcatgagccaccgcgcccggcctgtaagatattttttatctgagttgttccgtgtatgaagctatgtgaaaattcaatgaggtgtatacttaagatctgtacactctgttatgtgtaaattatacattaatatttaaaagaaaaataagtagattaataaagcacagtttggttttacagatacctatctatgacccaaccattctacatttaagtatatacccaacagatatgactgggaattttttacaccaaaagactttcattataatattatttttatatgcagacactcaaaacagttcaattgtccaccaacagcagaatgtaaaaatattttatggatcattgatagagtggaataaaatacagcaattaaagaactgctgctacatctgtggtgtcacaaatatgcctgcattcatagaaatttcctcaggaaaaatgaatctattgtagaggaagtcagaaaagtgttctattcggtagaagaaaattaatgaggcatgaaagaggcttctgaggtgctcttgtttatggtggtcacatgactgagtccatattgaaagattataaaaattgtacacttatgattgatgcactttttagtctataacaatgtattcatttgcaggagctactctccaaggtaccacaaaccgggtggcttaaaacaactcacatttattgtgtcacggtttgggaagctagaaggctgaaaacaagatgtagtcaaggtagtttcctccagaaggatataagggaggctgtctgtgtctcttgcatctctcccaggatctggtggtttgttggaaatcactggtgtttctgagtttacagatgtgtcagcccagtcttccatatagtgtctgcatatagtcttccctctgtgcatgttccccttgtgttcaattttcccctttttataagaacactagtaatattggattagtacccaccctaatgaccccattttaactagataacctctgtaaagactctatttctatataaggtcacattctaaagtattgggggttagggcattagcatatattttcgggaaaaacacagttcaacccatagcaacatataattccatttttaaaatcccaaaattacatctagcctaaaaaggaatgaaattgaaataaagatcgcagaggcctgcagtaagccttgatgatgtaatacctgtttataaaccaaatgttagaatggcttgaaacagaattgaacatttttgcgctataagacacataggagaaattttaagtactttttttggatgagacattagtctcaacaagactgaatgattttcttttaaggtcacacatttaaatagttaacaggagaaatagcgaccagaatcatagtcaaatacccacctaccccctttccaagacaactaaggtctcaaattgcgcccatttttctcaaattatttctagaatgtttagcaaaagaggcttttaatttggcatatctttgtctacagttttgtagtttatgtaaagaaaggtagactaagggaatttcattttaaaggtgagaatcagaatgacatttgtgaagctatgatgcctgtgccatctggcatacacgagggtgttgtactaaatgggatcagaatgagctccttttggaaggaaacctttaatagactgggaaacattaagggaatcttccctttttatttttatttaattttctttctttctttctttctttctttttttttttttttttttttgagatggagtctcgctctgtcacccaggctggagtgcagtggcgtgatctcgactcactgtaagctccgcctcctgggttcacgcctttctcctgtctcagcctcccgagtagctggggctacaggcgcccaccaccacgcccggctaattttttgtatttttagtagagatggggttttacagtgttagccaggatggtctcgatctcctgaccttgtgatccgcccgcctcagcctcccaaagtgctgggattacaagcgagagccaccatgcccggccttttatttttaatagagcattggaaaatgaattctgcatagctagctaatgaaggaaatccagagtcattgccaaaaccgagttttaaaggaatttgcaatccttcacagttcattcaaggaggcaatggaaattttgaagaagaatttttttaaaatctttcttaaaaggagcccttacattggcattgtatcacgactaaagtcttgctccctccctctctcccttctatgctttttgtttctcttttctatctttcaatgacatcagtttcatggagataaatggttaaaagataatgattacaacacatacagttgagtgacacaaatcttgttgtagtgttagaaatacatcaatacattgggatcataaagataaatggcaagaaaaaaaatctaagttaataacagaaaatgctgattcccacagtccgtgtagaaaatacacgttttttcctgtcagtggagataactgagaccagttaatattgtcaattctgttccttctgactgagccaggtgaggcaaaatttagcagatgacttgagggacaaaactatgaccttggcaacataaaaattaatactgtctacattgtttactaggaaatgcatgcaaaattaatacactcttggtagtacaggttggtttcacttctatagtgtgtagttactagaaagctgattcaacagatgatagattcaacagacgacatagaattgtctaaaatccagccgggcgcagggcctcacgcctgtactcccagcactttgggaggccgaggagggcagatcacaatgttaggagatcgagaccatcctggctaacatggtgaaaccccgtctctactaaaaatacaaaaaaattagccaggagtggtggtgggtgtctgtagccccagacactcggaaggctgaggcagaagaatggcgtgaacccgggaagcggagcttgcagtagtgagcggagatcgcgccactgcactccggcctgggcgacagtgcgagactccagctaaaaaaaaaaaaaaaaaaaagaattgcctgaaattcatcttcaattagtccatggcatgttttggaatttattcacttgtttgcctcaggaacagtagctgttcagatttgttctttgattttggaaatgaggttaccgtgctctgtagtgtcaggaagatgacgtggcataatcaggcaaacggctaggcattttctcagcagtaaattaccagtgcccttgcttgccataatacccacaaaaggcagaggcagtttcctgaggcaatccaggccacaaagaactgtacatttggggaaaacgtatcttcaaatatatatgttaaaatctaaaaaattggttagtatgtattacttttgtggatatttaaacattccctatgcataaagacctagttaaagaggtgcaggcatttggcatgttaaataactccttgatgagaaaccacactatgaataataaatatgacttaataaaaatgaaaaataatgagattagtttctattgaactattcttgcttagaatgcccctgaatttcagtcatagaaattcacttgtacctgggtaagttacaagtacttatttgtgctggtttctgtgtcattggcaattaaaattttggtaagttgaataaaagatctttctaaaaagggagttcttttttttttcttttttgagggggacggagtctcgctctgtcgcccaggctggagtgcagtggcgcgatctcggctcaccgcaaactccacctcccgggtccatgccattctcctgcctcagcctcccgagtagctgggactaccggcgcccgccaccacgcccggctaatttttttttgtatttttagtagagactgggtttcaccgtgttagccaggatggtctccatcttctgacctcgtgatccgccctcctccgccttccaacgtgctgggattacaggtgtgagccaccgcgcccggccaaaagggagttcttacactggcaatgtatcatgattaacgttttcctccctctttctctccctcccacatatgtattttcgtgtcagtatatgtatatgtgatttgtgccatttgtgtgtgtgtaggtaaatgaaagtggcatcaagaaaatctcacattaaaaaaatttgagatagtacaattcttatgcatcatatgttgcataatgtttgactattaagaaatttgcatcacacgtctacttatttcattaaacatgttacaggcaattaatttacttacaccctccatttcttttttcccactctctgggtctcctgctgcagggtcattatatgttccactcacaaaatgtccttgtttttcccttactcctgtcattgatcttctgaatctttctggtgaatttagcatggatgttttgatagaaagctctggcattaactctggagttgttttgcaaggaagattgttctctttttcaccattttttttttaggtccttgaagtgttttcacatagatatttcacaagagccatttcagaactgagaacattcggcgtgcacttttcctcttttggtcccacagtttttatgagtcctacttgaaattatgtttgctcccgtttcaattgtaatattgcacttactcattagtttttagtttgaactctcctgggaggtctaatgtagagtttggacaaagacacagattcataataaacctacccagtcaatttggtataaaggcttagaaggtggaactggccacattttgaattggaggtaagtatcaggaatggtaatggagagacatacaggattttcttatgggaacaagaaacaacctctgggcagtattagagcccagagagtgaaaagcctcttctaacttcaatattctatgtacaaatttacaagacttttttttttctttttttttgagacggagtctcactcagtatcccaggccggagtgcaatggtgcgatctcagctcactgcaagctccgcctcccgggttcacgccattctcctgcctcagcctcgcgagtagctgggactacaggcgcctgccacacccggctaatttttgtatttttagtagagactgggtttcaccgtgttagccaggatggtctccatctcctgacctcgtgagccaccgcgcccggctgagacttttaattgacagactgcattgcataagccaaaggccaacagagaggtgacctttcaaattactggcacaacaggagccgagatcagaaagctccaacttaatgcaaacatcgacaagaaatccgacagaaatgacttctgtgtctggtcaacttaacataacatgacatattgtcaagcgcattttgctttttaggtagaattgtctataacgatttaactgctttagaaaatataaatgtgaagatttgtggtattcgggtttatatataagatatttctacatttaaaagagacagagtggaaaagcttgatataagatttgtaaaatatgtttgtaataatgctaatggaagaggtgagagttgggtggggtggggtgtagatgggaacatggtttggggattggggaaagggaagtcatgctgttaataaaatagtgaggcatgttgtataaagtgtgttttatgtctcaattgaaatgttatagagagaaatttaaaatagatcatgattggttttgaatctgatttctaattttaaaatgttatgagcttttgttgctttcctatttcatacacatttctttatgggtttcacttagactgcatgaaattgcagatgccaattaccttttaataaaattaaattcacatatatgtataatttgcatgtatatattcacggaattttttattctatacgtgatatattattttaaaatggtttatcaatgacataacgtataatttttctatactttcagttttctggtttggattttttctggcaacactaattttcacctacctatactcattgatagtataaagttgtacaagtgcatatttgaccatgattacagttgaatagatgactggaggtacatctatgatgactaatactttctaaacacatatttacctctcatatatctgtgtaaatgattgtaagaggaaggggaaaatagagatgtatcattaggtatactgtcttaaagcacattcagctgctctcatgtttggagaattttgaatgtgatgaatgtttctctttcaccgctaacaggttgtgtgtgtgagccagattttattgcaagtgtttgaaagactattgcaaatatcggatattgccagacagttggtaaaaagcaaattgagtctattgagaaattaattcaccagctgaaggaagcacatttgccttacagtcatcagatattctacccaccagactcatctccgagatagcatcctaatgagcttcctaaaccaactaaacatgagcaggaagcatcagtcgtcaaaactgactcttttcagccaatcagctgactgcacaaactgtatggcattgaggaaaggaagaacattctgaaagtttttttttttcattctgccctcactttgttggtttctcagttttacagatgcagtgtcatgcgcagaaccctgtaaatgagcatagttcattcaagtatataaagtgctttcgtgtattattattcagtggaataaaatgaatgttaacaggcttaagtgattttcctaaaggcacacaattaatgtatggctggaattcaaaatcgggtcttttcctctgttctgattgttctataaataggggtgtagtgattgattttctacccaccatgacagggaataggttcaaaacttaaaaccctgttcattttataattaggtagactcaaatgacaggtcaaggcagggaggggagccagtcatttttattcccatatgggtttgctccttcaaagacaggattggggtagcagggtcagttcctacaggttataacgatcttaatgataaagttaactaaccataactgaatagtcataatgtgctagcacttttcataatgtatcccaaataatactcacaaaaccttccaaataaatgttacctttttgttatctttgttttattttgtttgagacagggtttcagtctgctgcccaggctttagtgcagtgatgcaatcatggttcactgcagcgtcaaactcctgggctcaagcaatcctcccacctcagcctcccaagaagctaagactacaggcatgcaccaccactcccagctccaaataaatattcttatcccattttactgatgcagaaaaacgtatggcccagagaagtaatgttaagtttattgggggatttaagttgtaaaaaattattttatcgaaccctaatgtaaactatggactctgggtgatagtgatgcgtcagtgtaggttcatcgattatagcaaatgcatcattctggtgcaggatgttgacagtgggggaagctgtgtgtgtaagggagtagggagtctaggggaactcttctactttccactcaattttgctgtgagtctaaaactactctaaaaaatgaagcttattaatcaaaaaaaattcttatattttatgaatatatgggacagctattcatgtatgtggtaaaaagagatttgttacaatactcggcaggagtgtgtctaatatgactgatattcatgtgtcacttataaaaactggcttcataatctgtagattcatttcatttgtgtatgttcgcttaagggcgcacacatggaaacactttggtgttattaaaggtctgttgggagggctcctctttggtggaagctatgtctatttcttaaaagtgatttaagagtaagatgtgaaatagcacttgcccccgaggatggagccaacagagcataggggagttatgtgatgctatctctgagagactggagagaggaatataaaaagcttattccttaaaaaagaataggggaggacttccttacctgatatctcagattatgaagctacagttctctccctgctttagggaaaaataataataacatactttttgcaaaaatcaattactgaacatattcctatattttagatttataatgaagcatttttgtacatattcattaaaaaagagtaattaaaatatttttctctggtttatagtaactaggatggcaacacagatatatcttggaagtatttcttgggatgattcttcaacataaaactattcttaaaaacttcttagaagtctccaggtactcaggaataaggtcattttaaattattccttattgaccataagaaaaataattaggcaagaccacaaaactaaatgtttagactgtttctcctgtttcctgattttcaggttatttttttatcccaattttattttgctgtatggtcatacatttcatctttgaaataaagtatataataatcacttttttttttttttttgagacagagtctcgctctgtcgcccaggctggagtgcagtggcacgatctccgctcactgcaagctccgcctcccgggttcatgccattctcctgcctcagcctccccagtagctgggactacaggcgcctgccaccatgtccggctaattttttgtattttttttttttttttttttagtagagacggggtttcaccgtgttagccaggatggcctcgatctcctgacctcgtgattttcaaagctgttcgagggcatttatcaggcttttaactctaggtactctttcccgcagtgtgacggccaagagaagggatcctgggctctcttccctggccccaggacgggaattcagggggaaaattcacctactcttatcccacaaaagaaaacttattcatcagttgtcaagctaaggagcttcagagtccataaagagggaaattgctaagagcttatcagtagtgtccaccccgcatccccacctggggtcacatggagaatgatggtgggggcaccgatcttgtcctgcttcaggtgaaaagcaggggtgtgggggggtttcattgtgaagggctcctttgttaaaattccttccaattccaggaaaaacatgcactccaaaagccattatctcttttactttgtactaggggacttccaggaaagagagagaggagaaagaagagggcaaaacaactgcagtgaatttagtcacctctccaattgcctttcttgttgcagaatatttcacattccaggaatttccttcttgacctctggactgttgatacacccaagatcttaatatgctttcaatcataggttaaagacatcaagcgccagatcgcttgggcctaggagttccagaccggcctggacagaatagtgaaacccagtcacattttttttttaagggggagatttgctcttgttgcccaggctggagtgcagtggcgaggtctcggcttgtgggacctctgcctcccgggtttggatggttctcctgccacagcctcccgagtggctgggattgtgtgagccaccatgcccaactaattccctaactgtgcaactgcaaggtcactaaacaaactcgtcacaaaacatatttttccttaaatagtaaaaaataatataatgtatgtttcaattaaataagtatctttgtttctcgcttctataatatgcttctccctgcacagatctcccccttcgccccacataatgcttgaaaggtaactcttggttcagtactcaatcctttaaatgttaatccgactgggctggtgcacctaaataattaataaatgtcctcctaaaccccatgagtctatctaattccttaaaaatccctctacaggactgcaggtgtgagccaccgcaccccgcccaatttattaatcagagaggaatagatgggcctggcttggtggcttgcgcttgtgatccaaggactttggatggcagagcactggggatcatttgagcctaggagatccagacaggcctgggcaacatggtgaaactcggtctctttttttttttttgaggcggagtttcgctcttgttgcccaggctggagtgcagtggtgcagtctcggctccccgccgcctccgcctcttgggtttgggtggttcttctgcctcaacctccctaatggctgagattgcaggtgtgagccaccatgcctaattttcttttttctttttttttttttttggtacacacagggtttctacctgttggtcaggctggtctcaaactcaggacctcaggttatccgcccgccttggcttccgggggtgctgggattgcaggcgtgagccagcacgcaaagcccaactaattaatcagaaaggaatagatcggcctggcgtggtggctcacgcttgtggtcccaggacgtcggacggccgagcgcgggggatcgatcacttgagcctaggagttccacaccggcctgggcaacatggtgaaacccggtctctcttctcttttttttttggtacagacagggtttctccatgttcatcaggctggtctcaaactcccgacctcaggttatccgcccgcctcctgggcctccgggggtgctgggattgcaggcgtgagccagcgcgcccagcccagtttattaatcagaaaggaatagatcggccttgcatggtggctcacgcttatgatcccaggaatttggacggctgagcgcggcggatcgcttgagcgtaggagttcgttctatacttgcctgggcaacatggtgaaacccggtcactttttgtttgttttgaggcggagattcgcttttgttgcccaggctggagtgcagtggtgaggtcttggctcaacgggcctccgcctcccgggtttgggtggttctcctgccacagcctcccgagtggctgggattgcacgcgtgagccaccatgcccagctcattttgttttttgttcgtttgtttttgttgttggagatggggtttctccatgttcataaggctggtctcaaactccaacctcaggttatccgcccgcctcgggcgtccggaggtgctgggattgcaggcttgagccagcgcccaaggcccaatttataaatcacaaaggaatagcgtgggggatcgcttgagcctaggagttccagacaggccggggcaacatggtgaaacccggtctttttttttttttgaggcagtttcactcttgttgcccggttggagtgcagtggcgcggtctcggctcccggcggcctccgcctattgggtttgggttgttctcctgcctcagcctccggagcggctgggattacaggcgtgagccaccatgcccggctaatttttttttttttttttttggtatagacggggtttctcccttcgtcagggtagtctcaaactcctgacctcaggttacccgcctgcttcggcctcccggggtgctgggattgcaggcgtgagccaccatgcccagctttttattttttttcttttttggtagagacgggtttctccatgttggtcaggctggtctcaaactcccgacctcaggtggtccgcccgcctccgcctcccagggtgctgggattgcaggagggagccaccgcgccgggcccaatttattaatcagaaaggaacagatgggcctggcgtggtggctcacccttgtgatcccgggacttcagatggccgagcgcggcggatcgcttgagcctaggagttccaggccggctggggcaacatggtgaaacccagtccctctttttttttttttttttttgatagggagtttcgctcttgttgcccaggctagagtgcagtggcagggtctcggctccccgcagcctcggcctcccaggtttgggtggttctcctgcctcagcctcccgagtggctgggattgcaggcatgagccaccgtgccctgctaattttgtattttgtatttttttttttttttttggtagagatggggttttctccatgttggtcaggctggcctcaatctgacctcaggttatccgaccgcctcggcctccctgggtgttaggatcgcaggcgttaaccaccacgcccagcccaatttttaatcagacaggaatagatcggcctggtgtcatggctcgcgcttgtgatcccaggactttggacggctgagcgcggtgaatcgcttgagcctaggagatccagacccgcctgggcaacatggtgaaacccgtttttgtttttgttttgttttcgaggcggagtttccctcttgttgcccaggctggagtgcagtggcgtggtctcggcttcccgggcctccgcctcccgggtttgggtgattctcctgcttcagcctcctgagtggctgggattgcaggcgtgagccaccatgcccggctacttttttattatttatttattttggttgagatggggtttctccatgttggtcaggctggtctccagctcctaacctcgggtgatccgccggcctcggccttccggggtgctgcgattgcaggcctgagtcactgcgcctggcccgaaacccagtcccttaattgaaaaacaaaacaaaaaccacaaagattagcggggcctggtgggcccggcgggtagtcccagctactctgaaggctgatgtaggaggattgcttgagccggagaggggtgggggtgaggtggcagtgagccatgttggcgctgctgcagtccaaactgggcgatagagcgggactgtgtctcaggaaaacaggaaaaaaaaaaaagaagaaaaagaaagtacataaaattgctaaatcaaggaacagcttgacagtatattattgagagaaatagaggcaaaggcgagcagacaccaatgttcacttagtggaactgcagttgtccccagacaggaggctgctacttttccaaaagaaatctattattgacaaaaaaaaaaaaaaagggggtttgttacaatatacaaatagctaaactttatatagccacgaccctcttgcagcactgctctaagccttttcctgctctgaaatagctactattgttacctccattgtagagaatacagatgccagaggttgttgtggaaggaccatggaaactgactaggaaattgacttgtaagtttaggacttaaaggttcttcctgttttgctccttacattgccacattttagttaacatacctcctaaaatactggtcctttctatatttggagggactcgtcttgcagtttgaagttttttcttgcactaagcatttggtcagaagatcatgtgcgttttatgtcagtttaagtttagacattgttcagtaaggaatgtaaatatgagcaaacagttacctgattaaatagaaaacctagaagaaaaatcacctatgagaaagtcaagaaaatgtgaactctggatttgtggctattttcagaatattaatttttttggtatttaatggcattgtgaatatatttatttttaaaaattccttgtcttctgcagatacatatacggtaattaaaaaatgatatgatgtatagattttacttcaaaataattcagaggaagaaggaatgcatataaatgaagtgggaatataaatgaaacaaaactggctgtggccaggtgtggtggctcacgcctgtaatcccagcactttgggagactgaggcaggtggatcacctgaggtcaggagttcaagaccagcctggccaacgtggtgaaacatcatctctactaaaaatacaacagttagccggatgtggtgccgggtgcctgtaatcccagctacttgggaggctgaggcaggagaatcgcttgaacctgagaggcagaatttgcagtgagccaagatcatgacactgcactccagcctgggcgaccacagcaaaatcccacctttaaaaacaaacaacaaaaaaccaacaaaaacaaaaaactgtccatgccatgaatgaaaaattgttgatgatgtgtatatgtagggcagttacattatttttctcaactttttttacatctgaaactttttaatgaacacatgcacacgtcccttgataactggggctgcttccccattactctctcaatagcccttctgattttcacttcatcttcattcttagagactctggattttttattttttttggcaagttcaagtatgtcttgatctatgcaaggactagccagcatgtctacctactcagccatattatcagaaacagaaaaagtgtccagattcttgtcttttcctgttaagattttttaaattccaagaacagtcaccttctaccagacactctgatgttggaagacaaagcatatttcgtaagtggcatgatttctgtgctcaagtttagaacaaagccacagatttcaacatctcaaaaataacttactggactcaccaaatttagaaagatggagattattttaaaaaaagaaaaccttaatttactatgtgacctctaagtatctcagctgaaaattgtaaagataggtaaatcaaaagatgcagataatcatgcacttaatgaagcgctaaatcaaagtatttttggcatatgtgagtttcattttatcacattttttactggtactatagctatttgcaagtacatatagaactacagtgttacatataaactaccaaaaagcaactttttaaaaaaattttattattcttatactttaagttttagggtagatgtgcacaaagtacaggttagttccatatgtatacatgtgccatgttggtgtgctgcacccattcacttgtcatttagcattaggtatacctcctaatgctatccctccccctccccccaccccacaacagtccccggtgtgtgatgttccccttcctgtgtctatgtgttctcattcttcaattcccacctatgagtgagaacatgcggtgtttgtttttttgtccttgcgatagtttgctgagaatgatggtttccagtttcatccatgtccctacaaaggacgtgaactcatcatttttttatggctgcatagcattcgttggtgtatatatgccaccttttcttaatccagtctatcattgttagacatttgggttggttccaagtctttgctattgtgaataatgccgcaataaacatatgtgtgcatgtgtctttatagcagcatgatttatagtcctttgggtatatacccagtaatgggatggctgggtcaaatggtatttctagttctagatccctgaggatctagacacactgacttccacagtggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttcttcatgtgctttttggctgcataaatgtcttcttttgagaagtgtctgttcatatcctttgcccactttttgatggggttgcttgtatttttcttgtaaatttgttggagttcattgtagattctggatattagtcctttgtgagatgagtaggttgcgaaaattttctcccattttgtcaaaaaacagctttttaagaaatgagactaatctagcaactttattgagaggacgtgaagtgtttggttaggaatggtgcaattggtggtggttgtggacatgtgagatgtaagatgcctcaacttccaatgttgttcagaagcaatccagctttctgaattattcttatgaattctggatttgaaacagtaacttcccaaatggcaggggctttcagcagagaggaacctggagggaccctgtccctgacaccttctgggttgttagctccagatcaaaagaactcctgatttggaaaaagcttcttgaaaagaagaggggaggtgaccttggtgaagcctctggggacatgagctatttttagggcttttggcaggaaaagagcttttgaaaacggagataaggcatggtattaaaaaggcttacattggagaaagaaatcataaaactccatacagttagggcaatagttttgttttttactaggacagcatcagtttattggagtatttatataacataagcaaggtctcttgatattttaacaattaacaactggattttattttctactataggtgcagtttatcattctgaatccaaagccaaggaatataaacatgtatgcaaacgagcttgtcagagagtatcaacgcaatgtgtatcatctatgcttttcagttttgaacataaagcagtggctctgagcgcgactcggagggcgacgccgcggccgcagccatgggtgctgggcctgcaggggcgcgggggggagggcgacgctaggacctgcggggccgggcgggagagagggctgccgggaccggccctagacactgagccgcggtgggatccccgccggctctgcgaggccctgcgagcgccagggaggcgcctcgagggagccgggcagccgccggccacttcaggggggcccgccacttcagggcggtcgaaagagccttgggggcacatctcggggtgcggtgacccgcccggcgcatttcgggggtcggggcgcatttgccaggggacatctggagcccggccctgcttctgtcgggctccagggtacccctggatggctgcgctgtgccctcgccggcggcccgggcgccacagcggctgagttcgccgggatcgccgggccgccgccgcccttgccaccggctgcatgctcggcgcccgggtcgcggcccacctggacgcactgggccccctggtcccctacgtgccgccgccgctgctgccctctatgttctacgtgggcctgttcttcgtcaatgtgctgatcctgtactacgccttcctcatggagtacatcgtcctcaacgtgggcctcgtcttcctgttcgaggacatggaccaggcgctcgtggacctcggcgtgctctccgaccccggctcgggcctttacgatgctgactcggagctcgacgtctttgatgggtacttggagtagggtctcgactgccgttcccctcttccctccacgatccgcaacccacgccctggaccagccgcccagatcatggcgccgcagcagctggttgggggcaccatctggacggggatggttccccaggaggagaccctcccctgcctccgaggcctgcctgctaccctcaaaagcttcgtgccaacagagaggttcctgtttggacccaggagagtggaagagagattgggactgagtgctgagattgggaaggcacctgctcccacagaagggggaacgcaaggggcgtcccaagacctcatctgcctgcagcgtcacaccgatggcctggcctcggcttctcattatttgcaactgccatggatgtttacaggaacccagccagagtttgcctccctgcacttcatcccagagcgcacctgcttcctccacttcaccttcggagaggacacttcaaactgcggacacacgcaaaagcaactcccagctctgtttgatgtgagttgagccttcaggccagctgggtttagcccgaggctggtcttagatgcagcgactgtttcagggagtgactcagaataaaaagaagctgaggaagctgttggggggctgaggatgagattctcgcttcttcatttcaggttactcgttcctcagcaagttggcaaaacagatatcatgctggtgagtgccacgttactcccctggctgcaaatgcttttctgaaagtatgagtgtcgtgcctacttaattctgataaacctgtttaagcaatacttaggaggctgacttctttggattaaaaaaatgtatgcaactccaaaaaaaaaaaaaaaaaaaagaaattcaacatttaaaagtttcatttctagggcagtcttccggtttggactacaaaattattttgcttgtttttgtaggggatcgttttgtgttgttttgtgtctttctccacatgatgcttagctctttccccacgtcccagattaaagtctgtatttttgtaattgtgggcacacaatcatatctcttttaatctttgcaacgatgttgaacttctgtagacagaaggatagagaaaacagcttgaaggcagtcagtgtgtttttccatgaagggaaaaaaataaataaaaaaattaaaatgggtgcttttttaagagagattgtcctatactttttcattctgtttttcatcacgtagtttgtatcatagcaagttcattgtcattccagagttcagctttgcccttgtactcagttgtgcttttttcccattggtttttgaggttttgctaaactgttgaatatttaatgtggggacaggaatggactcagaagaaatgttttttattttgattcttactagtcttgtaggcaaaccttccattactttttatgcaaataggatctagttgaatattgtatatcgagtaaatatgcgtctctctctgctcttttcgttgatatttacataacattaaaaagattatactttatcagagattcaagctttttcttatgaatgaagccctataaataagaatattttgttacagggattttgttcttttgaaatttataacaataaagctaaaagttctctaagctgttttatattttttcttatttttcaaagtgtgaaatttttctatcatctgaaaataaattttatgtaactatagtcttagaaatttaatacatttgaattgtatatttagcctctttaatatttccaatgaatacacttcttaaaagtttaattaggaatacagttcttagtttttgagctttctctttgttgactaaattgaaatgttaataaatcatttataaatgacttttccttctctctcttttcctctcctaatttatgctcaaggccaggtgattttatagacctttattctgtgtagtttatattacaaaataatatgttacatcttgatttagaatttacattatagtatccaaaatgtttttgtcaaatgtgtgcttttatcctcagattccggcgcccctgtgactcagagtcacttctttttaggtatggagagtattaacggggaggagaaatgattcgtttgagatttagttatctatataaaatacgaattgtcaggatatttgaaccaaactgggtcatacaatttctgtggctattttgaatagccttacaatgaattaagcttactaaattccttgtacttttcatttaatagctagatgttattgttttaatttgaataatattaagtgagccatattaccaattaacctgaatataaacacttgcttgtttttaatctgagtagtttatgtcttaaagtatggaatggaactagtggtcaatttttattaatctaagtgtctcccatacttctttaagcttttggaaagtttgggaagttgtgattttgcaatgaataatctctccccttggtttcataggcaattgaaaagctgcaggcgggtgctcttgcaactgacgcagtcactgcagcactggtggaacttgaggtatttcttttctctgttttattgaaaatacttgtgagtttatctttattgttcttaaatgacatgaaactgttgagttagtcaaccataaattatatgaccagtgttgcccaccaatattagcacagttatgaagaagcctatgatattgttgttttcattggtgacttttctgagtaatatgaaagttggttaaattccttccttttcttgatttttttttttttgtgagattcatgaatacaaaagttagtgactggatactgaagtttctcattttcagtaggaaaatccttgaagttaacccccaaaaagtgatgtatgttctgttgtttaaaaataaattccaactgtctagaagtgcctaaagtagaaggggaagattcttcacgaacctaacagttagatatataccctgaaattgtgtgctgtgaagtgtgccttgtcccagtgttatggttaggtttgtccccagtttactgtggacatcgaataattgagtggggaggctctcacgtttgccataattttttatactctagagtgaggtcctctcagttctcttgatttggacccttgatgaatttgtgcaggggatattgaggtcttcagaagattgacttgctgctcgaacttggagaagatagatttgtatctatcagttgagaggattatcgtgaaaaatatttttctggttgagaatactccttagggaatcaagtaagacatgatgacgaaacaatgatgagtttgagggaggagatgatagttaaaggcgacatttccaggttgactgggttgtggcccttgtattcaggcgctcataccagggcacgcaccctttcatgcctttccttgtgaaaattgcccaggtgtttaccaaaagtcctagccgtgttttctgtatattctcatgcttaattgtggacctgagcttttgatcatgctttgtagattttaatttctcttggtaatgtcagattggtcctaatgtagtcaaggaaggtgaaagaatatggtgagcacctagttctattgaatcttacatggggatgtgtgatgccctcctaatatgactgatacatttcatgccagctctaccagtcattagccatgtgtccatgggtgtggcacagtctgtccttgactcagtttccctatttatgaggataataattcccacttcacagagttgtgaagattaactgagttcatatatgactaatacaggacagtctcttagaacagtgtgtggtacgtagtaagcacccataactgttagcaattattacagttatgaggtgctttggaagtggtatgtatgagatgaatatttatggtaactattaatgacaagttttacagcatcaaagaaagtttaattatatgttgaggatcagaggagaaaaatgacataagaaagaagatagatgtatttaccaccaaatgttacctttactcaaaacagacacacaaagagggcttcatctaacttaactaattcaattgttagttggaaattacttgcatggaatcagcataggtttgggaaagaaggttattgagtagctggagaatatactagaatggcaaccatgaatgcaaaactgaataaaattaagtttctctttttatcttagaataactttaattttcctaagtcatacttatatatcatgtttaatatttcattctattttcccctagtgttgaatctgacttttaagggatttacttatttatacttaaaaatgataagaatacattttgaaataatgagtttctcctgagtaagtggacttatagttttggataacttgtgtttttttaagagtgtggatatgaatttaaaggaaaaaaatttcttgttctattatttttgattggaataagtcataaggataatggtagcatagaattcttccccaagtgactttagagcatcccacacctcaacttttagttattttattttatatatatatatatttttgagatggattctcactctgtagcccaagctggagtgcagtggtgcgatcttggctcactgcaacctctgcctcccaggctgaagtgattcttgtgcctcagcttcccatgtagctgggactacaggcatgcaccaccacacccagctaatttttgtatttttttttttttttagtagagatggggtttcaccatgttgaccagggtggtcttgaactcctgagctcaggtgatccacctacctcggcctcccaaagtgctgcgattacaggtgagagccactgtgcctggcctcaacttttgattattaaatttgtggaagaatttcaattatctttaacaattaacttttctatggactctttgattgaaatacatgttaatagtttaaggttaagcttacactaacaggaagaattttcctaaatcttaagaattatgttggaaatcatgcttatactgccccctgcagtttctctcaccttgaataattgtgattcattaccttaaaacaggataggttttcagatggacttcagttggggaagtattgtaatagcttgggtcaatggaaagacgtaagaagattggattctaatatttttgtacttagaaaaatataagtagcagtattgagtcctttcagaatactgaaaagtgctgagaaaaattctggagagccttattaataatgcattatgtttaatttgagaataaatacttatcttagttttggtcagtctattcagttaagtcatgtctggattattgaacagatgcaaacagtcattgttctcttctctttagactttgggatatactttttgatttaaaaaatgatgttcttgccactgagcttaaggaaacaatacataaacatatttttaaaacttgcccgttatattattacttaggcagatattaaaattgatatgaattccttaaatactaattgtggattgaaatgactgaaatgttttaatggtctttattgcctagaaagagtatctggctgtatattttaaaaatgtgataatttgtattttcccaaatagtgaaaagtatactgatcttaactccatgcagtgaaggaggaagagacaaggcaaaagaaatatgtgtgtgtgtgtgtgtgtgtgtgtgtagtagtgtgttccacacacactaaagggaattatgcagacatatcattttttagcttttcttagagactgataattttgtgtcgttttatttttctttaccaccgctacagacaagtgatgtcatcttaagactgtcacttctggacaacagaatgaggtgttttcttcatttaagtaaaggaggagcaggtgcaaaagttcctatctattaaattgaccaccttctccctttagagttttgggagggaaggtggctgcttctgtatgagaggttttctgcagtgtggaaatgcaaatgatattactccaaagtatattttgtttatcttcaaaatgtagggaaggaaatggaaaggtcagtttatagatcatattttaatgatttattggtaagttgattcattcctgttgtttcgtatagcttttttgagattatcttaataactgatgagaaagtgaattctgttcactggatggtacaactctggtttcactcacagcagagaagattaatattgtgaaagaatttggtcttcatatttgggactatacatttggatgccagttgcttttttggctgcttttgaaatagttttggatcaagtagtgacagtggatttaagattccagaccataattttgcatatttcaaatggtaaaacttctaatgtgaatttcttttttgagaaaagtggatatagaactgggtgagtcatgatgctaccattttcttaggattgtttctaaaatagaaagtgtttcatggattctgatagaaaatgaactatctataaaatactgcctgaagctccttttgcacaatggtgtttttcttaaaaagtacaaagacctggtttaaaaaagtctaatgagtaataataggtgcaatatgaatgacagacttttggaaggtaatttataatcttttgtgagaaaactgatgaatttcgcagaggttttgaagatcttgttgtaacctttgagaaattttggttaattcattctgaaaactgattattttggtaggtagaataccgtgtattaagaatagtgataggggctgggcacagtggctcacgcctgtaatcccagcactttgggaggccgaagcggacgcatcacgaggtcaggagatcaagaccagcctggccaatatggtgaaaccccatctctaataaaaatacaaaaattagctgggcatggtggcgcgttcctgtaatcccagctagttgagaggctgaggcagaagaattgcttgaactgggacccaggaggcagaggttgcagtgagctgagactgcactgagactgcaccactgcactccagcttgggctacggactgagactccgtctaaaagaaaaaaaaaaaaaagaatagtgataggaatagcttttacgttttatgtagtaaaaggcaaattatacaggttcctttgttaaaaatcttttgttgaacttctgttattaaaaatggactgtgaagttttttattcacttaattcatgctttaaagctccctatggtcaggggagatgctaattcatggttaaaactcgtttcttgtccaaatgctttagcgtttatagggcagattatattgggccaagtttttagtcattctgttaaaaacagttcgtcgtctttggatctctgtgtaatacaaatattgcttgcttgtaaactctagggaagtcctttaagaataacttgttcagatgactgatattttggtatgtaagagaaagaaagtaggtattttcattatatatttatattatatataatactgttatacatttgtctgtatctttgttgttgttgagacagattcttgctctgtcgcccaggctggagtgcagtggtatgatctcggctcactgcaatctctacctcccaggttcaaacgattttcatgcctcagcctcctgagtagttgggactacaggtgtgcgccaccacacctggctaattttttttgtgtttttagtagagacggggttttgccacgttgcccaggctggcctcaagctcctggcctcaagtgatccatctgccttggcctcccaaagtgctggggtgacaggtgtgagccaccgtgcccagccaggtctgcatttctttaaggcagggatctccagaatgggaatgttggtcacacttgagtagttcattgtgagtggaccccagcgcaggcctcttgcgcagctgcaggaataggccatattctctcccctgggctttatacttccggctggaattgtctgtgtgcctcagggggatagaagaaacttctacggcctgccagtccttgaaatgcctagtggtcatggagatggtgtggcttcctgatggcatatgggcatacctaggatggaaggggacattgggaagagctgatacatttcccttttccctcaccaaacttataacaagttttcttgtgagcagatgcttaaccacaccctgctccctaccctacttcagtcatttggtttttattgcaaaaaaggaggggcatctactttaaggtcatttctgtgatttgggaagtttaaaattatttaaataaacgagcatctcatttcctgtacgtttttatttttgtagaaattatattttcataagcagagtggtcccttgctctttccccagcaccccctgccccccagtagagctgaccacactggaacgacagcttgatgcatttagctcacatttacgtaagtgctcattaactataatgtggctggtgagtctaattttagacctaccacccttgaaaatctcatttttcttttccattgataatatcttttattctctgtaaggggagtgggatgtgtttctatgtatgtgaagtagaatatttaccttttttcttttgtagtacttacaatgttttcattgcatgaaattggagttttgaccttaggtgctcttttttcctttttttttttcttaacttggtattattgatgatttcaaagatcctattttgcctgtctgtttagcagtattcccagtggtgcttcagtatttctgtgtattccagctgtttatggagtctttatgtttctctgcattttttattttttgaggtgtacacacacagttacgcttcatggagttgcatccagccaagtatccatgttcttcttgtgaagaggcagagaaaatcacctctcccaagaatttccaccttctgaacaagggaaatgtatccttaagagctgtatgcagatgggaggcaacttgtttgcttgttctgctgctagagcattggtttaattagaagacaggctgtgggtggccatgtgcagacaaagaagcaccagacagagcccgtttagcctgggtcagtaagagtaagttacactctttttaaaacacttttttgagtactgatgctgattcttgccttcagtactaaggggcaacttgtaacttactgtttgtgtttacacatagatacatctgttctttttctgagaccctagaaatgacacatgctctctagcacaaagtacctgcgcaatggaaaagcagtgatttcttccccaaccaccctttttttttttaagaataaaaagaaaatggaatcaatgattacattctagattaattttacactgtagcaaacccggtgttagcgtttgaccaagtcaaaacacttaagtatagagcttgtcatgcttttactttgtagtaatgggaacatgagaaacgattttagccttttccagccatttcttgataaggtatgtgggtctcatcagatacattcatccaggccgaacctagtagaagagagggtccaagatcagacctagcagttcctgaggagcatggaactctatatgtgtgcccttgtttttctctgggagttgttactctcaaaaatatacttcattttggaattcagttttgagctacctaaagccacatatggtagtgtggtggagttagtggaaatcctgtgtttttgactatgtgaaagcaatttagacttttggatttttgagtgtacaatgtcttctagtcctatattaatagggatattacacaaaagggatttaattagattcattggtcctaggatttatagtgttgtgatttttgaatctgtgtgtgtgtgtgtgtgtatttgtgtttgtttggatctgtatcatttgtggcatcaggtttataccttagcatctactgttttggtttgttttgctcttggtaatgaaggaagtaggctaaaaagatttttctatgtttggaaaatcacaggctggtatgatggtgtttaatttcaaagactaccttttgattttaagtttttttccatctctcaaacccacccctttattcagaatctggaaaagaatgaggaagaaacttaagttacataatttttaagattctcggcctggcacggtggctcacacctgtaatcccagcactttgggaggctgagacgggcagatcatgaggtcaggagatcgagaccatcctggctaacacggtgaaaccccgtctctactaaaaatacaaaaaattagccaggtgtggtggtgggtgcctgtagtcccagctacttgggaggctgaggcaggagaatggcatgaacccaggaagtggagcttgcagtgagccgagatcgcgccactgcattccagcctgggcgacagagcaagactccgtctcaaaacaaaacaaacaaaaaaccagattctcatcaagattctaaatcttgctcttctctctttctttctctttcatgtgttcattacctaagtgttagaataatgaaggattgtacctcactatagaaatcagcttaaagttgaatcttagacataccaattgacaaaagttctttggccattcccattgccaggcagtttttactggcagtcattctcactcagggtccagcctcctgcatggtgtacacatttcctgacagctcatgacacgcatgtactgtaacacaggacatcaacactataacacattcatagtggggaatttatttatgtttagtttttctggagtatgtgcaaatgtaagcatattttctagtgggttggaagtctttttattaaaaaaaccttagtagaggacttaaaagttactagtatccctctttcctctccagttctgaccatgtcatttgataaaaggatggtttaaattattataattccatggtctgttaggttcttcttgagtgatatttccatattattgtcaatatggttaaaaggtataattatttaggttgaagggaagtataagtagatgtatacagcagatggtagcctctagctgagatcccaaggagaatatcctgttactgggaaagggtgattatgtgtttatttagcaaacacaaagtgtttaccatgtgccaggtactctttaagcactttacaaatattggctcattagttttcacaagtgccctgagatgggtactgttgttagccctgtttgatgaggatactgatgcacagagtggttaagtaatttcctcaaggtcacatagctaggaagtgttggagccagaaatggaatcctgctgccgtgacccactcagtcaattttttttttttttttgagaccgagtcttgctctattgcccaggctgcagtgcagtggtgcaatctcggctcactgcaacctccgcctcctgggttcagacgattcttctgtctcagcctccccagtagctgggactacaggctcctaccattacactggctaatttttgtatttttagtagagatggggtttctccaagttggccagactggtcttgaactcatgacctcaggtgaggcacctgcctcagcctcccaaagtgctgggattacaggccttagccactgctcccggcccctcattcagtttaatcaacaaatgaacagcgtcactaaagatccctcaaactcagtgatgaacacatctgaaaaagttaaagaaaattaagttcaaagaagaaacttttcattgtcaccattgtcggtgaatgtagtgatctaaaaattctctttatcattgtgctttaaatagtgatttagttttgatctttaaatgtcaatagactattgatattttgatctttaaatatcaaatatgtatggactatgtgaatattgaaaagaaaatatgaacagtcacttttacagttcgggtttttgtcttaaaattttgttgtaatttctcttcctaatcttagatctgtttgaggagatggtgcctgtgtcagtgtggcagtctttggctgcctgtgatcagaggaaagccgatttgttaacagatcaattgctcagatgagagaagccaccactttggcaaatgggtaggtagagcttaattttagagcctaaagttttccgtttggttgttctttagtttgtgaacattttagtttctgagcttagagctaaatgtcaagagtatataaaatagaaaatgtagacacacacaactatttttggtggacactgtatttgtgaagctctagcaaatatagttggaagaaattatagaaacaaggtgaggatgtttgactaaaaatttgtattttaagagatatttatttgggggaaatgagaagtagaaatgaactcagatacatggtacgtttagtgttctgaaccaatttttgtttctgatggattggatactaagaaaataattcattggtttaaaaaatttttaggtatattttgcacacacaaaatacacctattctaagtacacagttcaattattattatatgtatatatatgtttatgtgtgtgtatatatatatttttttgtttgttttgttttgttttttgggacagggtcttattgtcaccaggctggagtgcagtggtgtaaacattaaacatggctcactgcaatctcaaccttctgggctcaggtgatcctcctgcctcagcctcctgtgtagctgaggccacaggtgcaagccaccgcacctggctaattttttcatttttttatagagacgagatctcgctttgttgcccaggctggtcttgaactcctgggctcctggtcttgaactcctgggctcaagtgatcctcttgccttgacctcccaaagtgctgggattacaggcatgagccaccatgcctggctatttagttagttttgataaatgtatgtacccatgtaaccggcactatgattaagatagagaacattactgttaccctaaaaaaattctctcatgcccctttcccagtccttcttctcctggcccctggccactattgatctgctccctgtcttaagtttagttttactttttatacaatttaaaatacatgtaatcattctagcatatacatatacagtacttacagtatgtacagtatatacttagaatgtgttttgctttttttcacttagttactgtttttgagattcatctatattatgtgtatcagtttgagtcttttctgtggctgagcagtattccattttatggttatggagtagtattccattttatggttatagagcagtttgttaactctttcacctgttaatggacatttcagtttctatgaacattcgtgtataaagcttcatgtggacatattttagttctcttgggtaaatacttaggagtggaattgttaggttgtgtggttagcatatttaattttacatgaaattgccaggttgttttccaaagtggttgttccattttatatcctatctgcactgtttgagaaatacagttgttctgcatcctcaccaatacttggtaccgtcagtctttttagttttagctgctttcgtgtgtgtgtagcagaatctcactgtgatttaatttgcattctcctaattactaatgatactgaacagcttttcatgtgcttactagccattcatatcttttctgtaaagtgtctattgaaatctttttctcagtttttaaaactgagttttcttaatatttaaagagttctttacctattttggaggcaagtcctttgtcagatacatacgattgagaatatagttgaccctgaacaacataggggttatgggtgctgacccccctgcacagccaaatctgcatataacttctgagtccccaaaacttaactactaatagcctgctgttgaccagaagccttactgataacataaacagtcaattaacacatattttgtatatgtattgtatagtatattcttataataaataagctagagaaaaaatgctattaagaaaatcataaggaagagaaaatatatttactatgattaaatggaagtggatcatcataaaggtcttcgtccttgtctatttcatgtttgagtaggctgaagaagaggaggaaggagggttggtcttgctgtcttagaggtggcaaaggtgaaagaggtgaaagtccacatatacatggactcacgtagttcaaatctgtgttgttcaggggccagctgtatttctctcgtggttggcttgccttttcatgtttttagttttgattaatgcatggattttaccatcatttttcttgaacaagaaaggaatgtaagtttactctagcatatgataaacaggcagtctgagattttacagagcttcttttctgaggagttcattgtattccatcatttcatttgccttttttctttacatagtaggtagggatatgtacctcccttccccatcatgtaaatgaaataactgaggaatcgttagtgtgctacaaaaccgagagcagatgaagattctgtaatgaagacttagatcatctatcttctgttgacattttgcctagatgatgtgaaattataattattgattctgttgaaagagagcaaaaaagaaaaaaatacctattttgtgtattgtttctgactcgttagagatgctgtaacaatcaaaagtataaaagactgcttttttaggatagaatttttgacttttaattacttagactgaaacaagtttgaactgtaagccaacgatacctaatatattttaatgcggtcataatttttcggcttttttttttttgtttttccagactgagtcttactctgtcgcccaggctggagtgcagtggtgagatctcagctcactgcaaccttcgtctcctggcttcaggtgattcttgtgcctcagcctcccaagtagctgggattataggtgctcaccactacgcctgactaatttttgtatttttagtagagatggggtttcaccgtgttggccaggctggccttgaattcctgacctcaggtgatccgcctgccttggcctcccaagtgctgggattacaggtgtgagccactgcaccagcctattttttggcttttaattctgaattgtgaacttaattttttaatgattttggtttaattgtatcaatcactgatttttttgtttttctgttaatctttgctttgtttttcattgatagggcttatccagtttttctgggtgctaactccattgctgttgatttggttatagaagattaaattaaataaagtaaatattgatgagttaaattgttttagacttcaatataacatagtatctcattttttcagagtgctagcttcccttaatcttccagcagcaattgaagatgtgtctggagacactgtacctcagtctatattgactaaatcaagatctgtgattgaacagggaggcatccagactgttgatcagttgactaaagaactgcctgaattactgcaatgaaatagagaaatcctagatgaggtatgttttataagatttgcttttcaagtataaacactgtgatcccttgatgtccagcagggattgggactggagacttcctcatgctagtgctcacagtgtagttagtattcatcactttggtgaatttactgtggcccagagccgcctctttagcataagagtaattctggttgagtgagaatgggtttcattcttatcttaagggtaagtaagtacacattaatgaaactcaaatgaccactgtgtaaaactagtatactatgagaaatcaactatcatatgaaccgttcagtctttgtaattattgatttattttatacatagcgtgtagcaagatttttctttttaatttaatttgtcttaacctggaaggttaaaccctttaatttatccctaatttcttgaaatatattaagtatatttattttatattatttatcttataattccaatgtctgtggtttctgtgggtttgattctatgatttgtaatttttgctgattcttgcttatggtggcttgttttctcttgtgttcagtttttttgttactgttttttaaaactttaaaaaatagtttcagatttacagagactttgcaaatttagtgtggaaagttcctgtatatttttcacctagcttccctgaaagttaaaatcttacgcggtcgtggcacattgttaaaactaggaaattgacattggtacagtattattactcagattttaccagttattccaccaacgttcctccttctgttccaagatccagtacagaatactgaattgcatttagtgttcagtgagttttgattgtgcattcatatttcctgtaatttatttgtgggaattcattgagatctgggtttaaggtgaattctagaaagaatttgtgtttgcttctgccataaaaaggcattatatacctggcacctcctcaaacttaagaggctttttcctttcttttataatcttttaattatagtagtaatttatcttaggactttgtgtcacacaaatagtgtggtttctagtcccaaattcaggcttttgatcaggaatctcagataatacttctttttttttttcttttttctttagagccaaggtccagacaggcatgttttcttctgtagggccgttttctgttttaaaaattcatccactgagaatcatctatttggaagtataccagtttgagtgtggagagtgcttttgatctgacctctcaccttttattgtccctacctatgtttcttgttgacttttcatgttctaaattcacaatgcaagtcaatggtgaactacacagctggtgaactatggatggtgggctagtgctggcttgtggcctacttttgtgtggttcactagttaaggataatttttatcttttttagagcattgtcaaaaaagaagaattctatgtgccatagactgtggcccacaaagcctaaaatatttactctgtggtgtttgacagaagtttgctattctttgtcctaagctatcagggattgtcatgtattgttggtgctagcactgtgtctactggtagattagtattttcttgtgtttctggccccctactatcctgtcatcttatctacacattaaaaggcatttaaaaatatattaaacataattttctgttcgttgtattggaatgaaattctaaatcttttattttttaatgtaattgatcagtttttcccctttgtttatggcttctatttatctattttaatcttaaaactttctttaaattgatacatggatgtaaatagtctcatgtattcttcctttttttttttactgagaaaggtgatagctaattcagccttaaatttataagactttttgttaaatgcattataacttagatgtctgcaagaaaaaagtcgatttatattctaacctagtattcccatctcaccaaattctcccttatattgtgtatgaacatttaataattgcattaaattttttaatccagaaatgacatttcagggttctttttgcttccttttaaagtcattaaggtttttggatgaagaagaagcaaccgataatgatttatgagcaaaatttaaggaacgctggcaaaggacatcatccaatgaactgtataagcctttaaaagcaggtaaaaatgtgtataaatgaccttcatttgaataaattcccaatttggacccacatttttacttgattaaattaggctcagttgtaaattcgtttttaccgaaattgtttttcctcagttttagtataaagattaaaaaagttcacaaaagtaatctgccaattgtcagaagtacagattcttaagaacagtataaagggaaaagttaaaatggtcctccaactttcattttctgttccaagctctgtgcatattttattttatttattttttttttgagacaaggtctcgctctgtcacttaggctggagtgcagtggcaggatcacagctcgctgcagccccaacctccagggctcagtcaatgcttctacctcagcctcctgagtagctgacaccgtagacatgtgctaccacgcctggctaatttttgtattttttgcagagacgaggttttaccgtgttgccctggctcgtcttgaactcctgggctcaagtgatccacctgcctccacttcccaaagtgatgagattacaggcttgaatcaccatgcctggcccctgcgcatattttaaaaacataaatgagagcatattatatttatggctttgtaatttttttttcatttagtagtgaatcctgggtggtaaaacgaaaatgagctttaagttattttgaggccaaatttatgcttcttaagactttgattatgaagattttgtgcttgctgagataaatgctgtcttcatggtggctggagattagttttatttatctttgtaaaaagtttgtatattattgagatttttctaaaaatctttttttttttaagtcacattgctcttttgagagaggaatacttttaaaataaatggaccaatttttggagagaatgatttcttcctacattcatgagttgtaggaaaagattaatattaattagcttttatttggcagatagtaaccaccaaatgtattttaaggtatagctatgcttttgattttataagtgattttgtcatctttccaaaaacgagaacgcaaagactgttaggagctgtttttatgattaagtgaattggggtctagagaaggggaagataagtaaagttggagactagaactcaacatataaccaggccatacacgttgctgttagaatcacttctgtgctctgcaaacctattttctcccagagggaaccagcttcagaacagttttagataaagctgtgcaagcagatggacacgtgaaagaatgttacccgtctcatcgtgaccccatcgtgcttttgtgtaagccagagcctgagctgaatgctgccatcccttctgctaatccagcaaagaccatgcagggcagtgaggtgagaagggcactttgatgtgggttgtcatctgcttaagaaaaccacattcaagccattttatataatgcactgccaattccttattgtcatctttaaaaaaatgcagaaataaattggggttgttatatttaaagtagtatatagactgtgtaataggaaattatactaatattaactatcctgtaatagtcacttccatttattgaatgcccttttttgaactaaattttagatacttcataggtcaacagtatttaatttgggttttataaaagagagaagcttggaagtatagaaatttcctgaaatgaaaggactgggtatggccagatacacaaattctttatttcttccattgttctctactcccttccaccttgtttccccgggactacctttgaaaggaagattggcaaggtgtgcgtgttaataaatggatagctccgtcatggtgtttctactgatgacaggaaagagaaaattgaatagtagggcatctgatttggaaagtcctaagagaaagtgcaactataatttaatggcctatcatggggaggtagggtaagttagtaggaaaagatagaggtcccaaatctctgcacaggaaaacaagccaaagggcaagaaatactgctgaaaacttcttgaaaaaagtgaatttcctgggatagtaagttctgaaaagtatgagttttgtttcttatttgtctttccacagatgcattttatatgtttcatatatgtattccaagacctactggatatctgctctgtgtaaggcactatggtaggtacattggaaaattaacatacaaattatacacaggctttaccctcaatttatgatccattgtggaatattagtcatgtacaaggatgactgtaatatagggaagaagtttaaaaatgtcacagggaaagtatagaagtatgttatgaggatttagatgaagtacttaaatttcagtaatttggagtagttctcttcagaggcttcttaagagattggcacattatgaggacagagtggataggcagaaaaagtaaacgtgtaggatcggagaagggctgagtagtggctgtgtctagagagttatccgaggcacagaggatctgcaaacacagcttttactcctgatttctcatgacagaaggtttacagacatgttgagaatggctggaatctgcttgtttatttatttattcaccaagtgtttgaaggcctgctattccagagcagtgctgagcaccttggtccctaacataaagagacaaaaaactgctctgggttacctttagtgtagggtaaatgcacaggtaccgggcacctctcaaagggaagagaaggctacgtagttgaatgtgcattgaacctgaatctaacgggggaacccagtggaacagggaatgtgagttgttgctttgaggacatagcggagaaaagggaggtggtcagaagattaacttgtgagcaacaaagaacccgaagaagaaactgtagacccttggaagagcaatacattctggtaccttttttattttagaaaaagatctctgtttagtactctctttgtattctttttggtgtcttgtacgtgactcagaattatgtggcttttgccctttgattcttctgctttcagtagaaaagtaaaaatggtttgtgctaagcaaaatctgcattagtatgcactgatttgttgatattttattcagttgtatcagttttattaatccttacttgtgttacacaggagaaaggaacttttatagtcaatatgaagtaattttttggaagctagagttcttgatggggtaaccacaaaatttcagtactctctatatattcgtttgtcgtgtgccttaatcaaataaggcaagcatcaggtttatcagagctatttcagatggttgtcataatagttgatgacgcattttagccagaatttttatgataaaaactcagttttttgattgctgattagagtgatgcaatgtatatgttttattaaaaagtccaagtttgatggtagggctgttttttcttttattgtgaagtagcctactttctagttacttattttcagtctctttgggcatctggttttagatattgagatactctgaaaaattttgcagactagtggtcatttgtatttcaagatttttgtattaaatacctaggatcactgcttgtgattggttgcctatgatctactgtggcctgaagtctggtctgtggttggctggccaagccttggccctaatgtatatggggctgagtctagccaggggaaggaacatctatttttttgcacaaggatgatgttcaattttactcaaagtgttacatctgctggaagtaacggagggggtacctttaaaaaaaaaaaaaaaccctttatctccttagaggtagagcataaagagaactgtttaaaactgtgtgccctcccagaggagtgccttttttggattcacagactagtggaggatctgcaaacacagcttttactcctgatttctcatgacagaaagtttatagacatgttgagaatggctggaatctgtttatttatttactcaccaagtgttttttgaaggcctgctattccagaactgtgctgagtaccttggtccctaacatagagagacaaaaaactcctctaggttacctttagtgtagggtaaatgtatcaagtttctgctttcgttggtgtagacatagttgcttatttgccttttctgaaaataaaatgacaaggttataaaagtaaaatagaagatttcattgagggcatttctttctttctttttttttttggccgtggggggacggagtcttgctctgtcacccaggctggagtgcagtggtgcaatcttggctcactgcaacctctgcctcctgggttcaagcaattctcctgcctcagcctcccgagtagctgggactgtaggcatgcgctactatgcccagctaattttcgtatatttagtagagacagggtttcaccatgttggccagggtggtctcgatctcttgacctcgtgatccacttgccttggcctcccaaagtgctgggattacaggcatgagccaccgcgcccggcccattgagggcatttcttacggcttatattgtacttggtgctgttaaatgccacagagggttttaaatctaaaactcgggtcaggaacctgtggcttgtgggccgaatcctctgcctcttctctttgtatggcctgggagctaaaaatgagttttacattttttaaatataaaactctactttctacttcattttttaaatggctaaaaaaaagtcaaacgaatgttttaatatgtgggcattatataaaattcagatttcagtgttaatacatttttgttgaaacatagctgcgctcattcatttacacattgtctttcatactacaaagcagagttaaagagttggaacagagactgtggcctactgaggcaaaaatattttctgtttggtcctttaccaaaaaagtttgtaagttcctgatctgaaagacaaagtattgacagcctaggtgatgccgttcctgccattctgtttgacctcatctcctgttctgccttttgtttactatgcttcagccagagtggcctttttttctttcctttgatcctgccaagcttgtgcctgccacaggactgttatatttgcgtttccttctgtgcagggctttcttcccatttccatggctattacctctttttcattagtctcagatgtcacctcttctccatctttgtcattgtctacccacattattctatttttgtgtatttgtttaatcctcccctttccatatttatttaatcctctctggtccccaaatgaaggaaaagactgtttttgttagtagtcgtgtccatggcatctagaatggtcccaaaacaaaaagcatttgtttgaatggtcatcgctggcagccttaacttaataaagggatacatttaattgcagttgaaaggtagctggagctgtgtataagaaataaatatgctaggattctaattatttatatactttgataacatgttaaacctcaaatttgaatttagaagaaaatttaggcagtggttttcttattatcgtggtcattcatttgtggaagcagtttaattcattttctacttcatttactctgttaaaatgaggcgagtgtcatataatctgaaatatgttaaactagtgcactgcatatgaatttttttaaaagatgttcgtaatataagggatctctatctttgtgtggtagtccacaagtttgttcataaattcgttgtttgaaatggcatttttttccccagaaagttagaattattgcatttttgaatatcacaggatttgttaactatttggccctctgtatcagtctggttagaaagcttctgtatcagtctggttggataccatggaagttgcggtaagcttttcttcctaatctaggtaatatgactgaatacttaccctttgttagaagttatgttgagcactttatatagattatctcagtcttcacaacagtcctgaaataggtactattatgcccattttgcagctgcgaaaattgagttttctaagtagtaacctgtccttgattgcacagtcactaagcccattatggtctctaagggagtatagtcagagttgaagtgtttttaattttctatgtaattacgttttttttgtgtaattacgtttcactttgatagaccattagttcatttgtttccatattcaagttttgacttaatcttgttttctgagtgtgtaaaaaatgttcatgattcaaaaggtacatgcagagtaagcctcattccttttccttctacttctttcctgtatacttcctgtaagtaatcatatccgttagtttctggtttgtccttactgattttctttttggaagaacaacaacaaacaaaaaacccaacctcccccaaaattatgcatacatatgtatacatatgtacatattatgtatgtgtatatttattttctgattttccttctgtcttactcaaaatgcagcacactatatatgcttttgtaccctttttttctcatttaataatatgtcctggaagtcacttggaaggaaacttttattcacatcgtctgatatcaagttctactaggtctttaaacagactttgtcatatccacccacgtatgattctttctcctcctccttccttttagagtttctgtggtttgatgctttctagactctaggaatcatatttctttccctttccacagccttctcccctgtaccctcttctttctctccctccctctctccttcccttcccccttccttcctctcttgtccccctcccccttctcttcctttcctttccttccattttaaaattaggatgtttagaagatatagatgtaaatgaggccaaaaaggaaattcgcctacatttagcagaaacctcgagtctctggtcttcacaaagggatgttactttggacgttcctatcaaggagttaactaagactgtggaagaaagagtagggtaggaatttttagaaacaggcagttggtagggggatcatgggaactggacttgctgctggtaatgagaaagacaggggtggagacagggctcatgatgtcctcttcttccctttgtctttccccctgttttctttctatgagcatcattggggcaagcagaatagggagattgggttgatgttcttggtggtcctagcaaagtatgaagagatgagtgaaaggggcagcttgaaagtgctcattagaaggcacttgaacactatgaatataaaggggtatttatgaatcaggtgggtataagtcagagagtgtcttgactgaatacaagagataaatctctgttttgtttttgtattttgttttgagacagggtttctctctgtcacccaggctggagtgcagtggcatgatcatggctcactgcagccttgaccccctgggctgaagcaatcctcctgcctcagcctctggagtagctgtgactgcaggtacacaccattgcacccaactaatttttttttaatgtagaaatgggggtctcactttgttgcctaggctggtctcgaactcctaggctcaggtgatcctcctaaagtgctgggattgcaggtatgaacctctacatctggcctaaaactcttaatgctatgaagagaggcacaagaaccctctttccttttcctctcccggtgtataaaataaatgtggtatatacctttatatctgtgtctttctctatttctttctccatctaccatgcttgcttcataactatctctatttctatcttcacctctatttctctatatctctgtctgtcagtctctctaggcaaaataggatatctacttacgtagcaaaatcataccttcccctgcttcacagccatgattgggagggagtagagtgtagagtggctaagagattggttttggaactagtcagacttaggtctcaaatttcacctctgccccttagtaactgtataaccatgtcacttaatttttttgagactcgttatccctatctttggaagagaggtcataaatatatataccccatggggtattgtaaggaatacataaaattatatttctgaagtgtttagcatggtgcctaacacataggagttcagtaaattgtagctgttggctactgttattaatgctgcttttgttttaatatgagtcaactgaaggtacagtgtctatctacataaacctgatgttcaatttatatttggctctctgagaactcatctctctctcagcccaaatgaacctttatatattatttccttcttgaaattggctttttttttcagttaaactaaagtgtcttttttattgtttaggttgtaaatgtcttaaaatccttattgtcaaatcttgatgaagtaaagaaggaaagagagggtctggagaatgacttgaaatctgtgaattttgacatgacaagcaagtttttgacagccctggctcaagatggcatgataaatgaagaagctctttctgttactgaactagatcgagtctatggaggtcttacaactaaagtccaagaatctctaaagaaacaggagggacttcttaaaaatattcaggtgaaatttatgtatttaataacatctatgttttaaaaattacagaaaagatatgtctggactaaacctatattcaattagaaaaatgacattggagaatatctgtagttgagagtagaacttaatacatatatattttgtaaaattaaacttggcatatcagttttatttgtgtctatgaaaccaagtcactccttgtttttttttttttttttttttttttgagatggagtctcgttctgtcgcccaggctggagtgcagtggtgcgatcttggctcactgcaagctccgcctcccgggttcacaccattctcccgcctcagccgcccgagtagctgggactacaggcgcccgccaccacgccctgctaattttttgtatttttagtagagacgggatttcaccgtgttagccaggatggtctccatctcctgacctcctgatcctccctccttggcctcccaaagtgctgggattacagacgtgagccaccacgcccggcagaaacaaagtcatttctatggctaaaatgttgcatattacttaggagtgcttgatacttctgatatttttcatggtttcaagtttttaatagctttgttttttttttccatacgggaggaaaatcgaaattagttggaattactgatacctttaattatacggctaacatacatacagacttcagtcattttttaaaaaaataatgcaaactaaatatgttgagaagtttgaagttagttttcgtgtttacagataggtagtttggactaacaaagacttgaaagtttgcccttttcatagttaatgtgcaaaattaaacatatatttctactcctaaacattgtatctatatatgatataaaatattccaaaaggtaaaataattttcatgttatattttttgcaagtgttatatactaatagaaatctgtgatcattattggttgttttgacttctattggatttttgaaatttttacttaagaaagatttaaagcataatgaggcttcaaaagagtatactaggtatttctagtaattttgcatatgtatttaattacatatgattttcataattggaaaagatcaataaaaatgttatgagccatattttataagtaaatgtaaatacataaatctttcttttaacaaggtctcacatcaggaattttcgaaaatgaagcaatctaataatgaagctaacttaagagaagaagttttgaagaatttagctactgcatgtgacaactttgttgaacttgtagctaattcgaaggaaggcacaaaggtatgaagtacatgcaaaaggaaccatagctagcaagtacagatgtgaacgtataggttggaagttaaatggtatttccagttgaaccaaattactctttgcctggaatgttagctttaatgccattgcctctgcgaagtttgttacaggagggagaaagcttaatgaaggtggcaacatttcatgggaaccttgaagaatgaattgcatatttcaactggcagaaaaggggtacaaatattccaggtagcaggaattagcagagatgtcaatgacacctttttaagggataggaagttgattaatttgatgaattttgaggggacaggagtagtcaaagctgatttgtgatggaaaagctgggcgggcatgacttttatattctgtgtggtggtttgctgaggacagacttgtggcctgcccaagtgtcagaaggcttgctgaatatgtaagtactttcttgccttgtcctttaaaaagtttagggaattcacttatatttgtttttaccaatttgtttttgagggaacagtgatttttaagttttctcagatgcataattccttttggtacttaacttcataataatcactgaataaagttaccttgatataaatacagtagctaaaatgtaaaaccctctgaagagagggtgaaaatactgcaaagccttccaaatagagaggatggtaaaatgccattttaacttggtttaaaatgctttgtttaaataggtaagctgagaaaaccctccagagagcctttagaaattcttttaagggtttctgaagtatgcttgcatttctttttttttttttttttatactttaagttttagggtacatgtgcacaacgtgcaggtttgttacatatgtatacatgtgccatgttggtgtgctgcacccattaactcgtcatttagcattaggtatatctcctaatgctatccctcccccctccccccatcccacaacagtccccggtgtgtgatgttccctttcctgtgtccatgtattctcattgttcaattcccacctatgagtgagaacgtgcagtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcagtaaacatatgagtgcatgtgtctttatagcagcatgatttataatcctttgggtatatacccagtaatgggatggctgggtcaaatggtatttctagttctagatccctgaggaatcaccacaccgacttccacaatggttgaactagtttacagtcccaccaacagtgtaaaagtgttcctatttctccacatcctctccagcacttgttgtttcctgactttttaatgatcgccgttctaactggtgtgagatggtatctcactgtggttttgatttgcatttctttgatggccagtgatgatgagcattttttcatgtgtttttggctgcataaatgtcttcttttgagaagtgtctgttcatatcctttgcccactttttgatggggagtatgcttgcatttctgtagtgaatttgaaaacctaatccttccacttaaataggtttcatgttattaaacaattgacttttctctaggaattaggaagattttcatgatcatgaaacttttaacttgttacatttttgatgataatgttctataaaaatgattttattatttttattttctttaggagtcttagatcatatttaatattaagttgttgggcctagtaaattgtatggatgtatctcatgcagatctcagttcttcggctttaactgtcattgacaaattagctttagatcacattactctctggattaaaaaattgttcttgttcattacttgtatttgttctttgcttatagttttacaatgagttgactgaaatcctggtcaggttccagaacaaatgcagcgatatagttttggcatggaagacagaaagagatgaactcttaaagtaagtctgttttgtgtatcaaattgtacttaagaattttcttttaaaaaatcatgtggagacttttggtgtgaacttggtagtatgagagcagtttccctccttttctcatggaagaaggaactagatagagtattttacaaagcaacaagtaaacagctgcacagtctgggaatgaaaggatgaaaagaagcagaaactctagatgcaggaagtacagtgaggtcacagaaatgataaaacagttcaggtggcagatctcaggaagtgccagtaaatacaagcaatttattttgaagtggcaaataggttccttacataaaactagagctatagaacatggaggagacgccgtgaatagctcagagaataccagcaaaatcactttcagaggaggctgctgagaaagcagggccagttaacatacgactcatttcctgctgagtaatcaacacggagtagcacagcgctgataaaaggtgaaaaacattaacaaaatttaataaaacttcatagatgaagaatatttaccaaaataatattgtcacagaataggtgaaaattatgagcaaacgtctgaccatgaactaaacaaaaagaacaacaacaacaaatgtaagaaggcagtcattctaaggccggggtccccagtcctggggccatggactggtactggttcgtggcctgttaggaactgggctgcacagcaggaggtgggtggcagacaggccggcggctgggcgagtattactgcctgagccccacctcctgtcaggtcagcctcagcattagattctcataggagcgcaaaccctattgtgaactgcccgtgtaagggatctaggttgtgcgttgcttaggagactctgactaatgcctgatgatctgaggtggaacagtttcatcctgaaatcatcttccgctcccctgtggaaaaattgtcttgcatgagaccggtccctgatgccataaaggtttggggactgctcctctaaggaacacttggagcagaaattccagaactgcaggaatatggtaagaaaacaggaagtggtaagatgtgaggtgtcagaattcaggaaagaagtagaagggaagaatcaaaccacgacatgggaaagagcacaaagggcgagtaaacactgaagaacacacaggaacacagagtagaaatgaggaaattaaaatgaaaccaaagtcaagaaagaatgagaaaggattagagagaagatgggcacagaagatctaatatgggcaaaactgaatttctctcaaagaagaaaaaccagacagaacagttatttaactttctgtaaacagagcacttatttcatgatactcaagaacattttcttaaaacaagtgaaggttgttgaaagaggatatcacatggtaggggaaattgatcaagaactgtcagcatcaaggcatataaattattggccttaaaaggtaatggcagaatcctttaggcagtcaggcaaaacaatcaaaccagtatataaaaaggtgaaaaaaattaggctggcagctctgtatgccagaagagagtggagtgattgctgtaatctcaaggatagtaaatatgagctaaagattttatatcatatagtaaatacatgctaaagattttatatccaaactgtccttcgggtgcataaaaagccatatattcattagtaataaatataaagagctgaaagagtcttataccgatgaccctttcagccaactagatctttattcatctctctgttcatgttcatgttcattcacctctctgctcatgttcatgagagaagttattttcttctacctctaagaaagagcaggtgagttgtttttagaatatttctactaaacctataaaaagcaaataattagaatgttttaaaaatggttctaaatgttttaaaaaaggtgacttttttttagatagagttttgctctgtcgcccaggctggagtgcaatgatgcaatcttcgctcactgcaacctccgcctcccgggttcaagcaattcttctgcctcagcttcccaagtagctggcattacaggtgtgcaccaccacgcctggctaatttttgtatttttagtagagacagggttttgccatgttggccaggctggtctcgaactcctgacctcaggtgattggaattacaggtgtgagccacccccccagcctaaaaaaagatgagtattctccatattagtcttaaagataaaaaaaacctaacaaagattaatacaaaacagtctacagaccagtttcagttatgaatatggatgcaaaagtcctaaataaagtatttgccagtaatagtcaccaggacgttaaaaaataattattgaccaaggggaggggggcatttattccagtattcagtattcagtgttttcatgtcaaaggaaagattacaggcttgtcttaatagatgaggcagaagcatttaagaaaatgagtgttctgatactcagtaaaataagaatagatagaagatagatgcttccgtaacatgaaaaaatatatatgtatgtgtgtgtatatatttctgcccaaaactcagtacagtgattaatggagaagcactataaacagttccctctgaagtcaagaacagacaacaaatgtcactgtcagcactatttttaaatactatactgcagtaccagccaagacaatcacgtgagagagaaatttaaaaattggaaaggaagaagtaaaactagcactatttacagacattatgattgtacaactacttgaaaacccaagagaaccccaaaactctgcaaataataaaataattattactgaagttgttgatcataaaaataatttgtagaaatcagtggctttcatgtaaataaacctatagaggataagatgaagagacccacttacggtagcaacaaaaaggataaaatataaaatataagtttgtcatatatgagacctgtgtgaagaaaaaactatttcaaggacacaaaagaaggcttgagcaagttaaaaagcatgttcttggataggatgactcaacttcatcaagatgtcaactctcagttaacttatgtatcaactgggcgtgatggcatgcacttctagtcccatctacttgggagattgaagtgggaggatggtttgagccctggaattctaggttgtagtgcgctatgattgtacctataaatagccacggtactccagtctgggcagcagtgagaccctatctctaataacaaacataaataaagaaataaacatatacggccgggcgcagtggctcacgcctgtaatcccagcactttgggaggccgaggcaggcggatcacgaggtcaggagatcgagaccatcctggctaacacggtgaaaccccgtctctactaaaaataaaaaaaattagccgggcgtggtggtgggcgcctgtagttccagctactcgggaggctgagacaggagaatggtgtgaacccgggaggcagagcttgcagtgagccgagatcgtgccactgtactccggcctgggcgacacagtgagactccgtctcaaaaaaaataaataaataaaaagaaataaacatatgcattcaacatgcttttgattaaaaaaaaatcagcttttcatttggaattagacaagttgatcctaaagttcaagtagaaaaagaaacaaggtcagccaggaaaacaataaaaagagtagtgaagggatactagttctaccagataataaggtatataataccatctttaattaaaacacagtggtactggtacatgattagacaaagacagaatagaaaatagaaatagattcaaatacatgtgtgaatttagtgtaaaagatcttcaaccaaccagaagaggttgtagtcaactgcccagccatttagaaaataaaagttatctttataccagagtaagttctgagtggaccaaacttgaaatttgtaaatgaaatataaagtataaaatagaatggaggagaattccttaataaagctgggatgggcaggatctaataactcctacttaaaatccagaagccattaaaaaaaagaaaagaataagtttctcatagaaatatgataaacagagtcaggatatgacaaattggggatccaatatttgaaacttattcacaggcaaaaggctaatttactttatttagaaaagaactcctagaaatgaacaagaagaaaacccaatagacaactgaggaaaagacgcaaatagaattttgcagacaaggaaatacaaatagctcttaaataaatgaaaaaaaatgaataccctcattcattataaaatacaaatcaaaattagtctgaagtaatatttttcagattggcaagaatctgaaagtttgtttaaagcctgttctgggtcttccacattcattattctctacggtcaatcacattccaaggattgttgcctccaatgcatgcctttttctcaattttattttctcccatcagagtcatgcacagattagctcccaagtgagctattataatggcctcctagcatctaaactctccttttttccaattgatagttctgccagagttgtcttcttaaagcagaggttagaccgcatttctcttaagtaaattccaatgacaccaaaacagtgattcttaataagaattacaagtagggaaatacagatgggagagtttgcttagtaaataagttcataaaatctaggttaaacaaagttaaatggggtttgctttttgctgttgctttgttaatgtgcatttgaaatttctaaagtggcattacatatccataatttcccttatctatttgacaaaggaatctggtttgtttagaagcattttttcagaactgtgataggtcaacctttcagaaattcctcattatcaacagtcaaatccagatgtattttctttggctctcacaacaggcttagaggaatttctagtctgttctcctgatgtttcattatgtgcatcttttgcttaggcctgttaaacctactcaatgtgtgtatcttctactccatgtctttattcctactgttgtcttaacaggaaatccttgcaacccaattcatagtttttgttctttggaaaaatccaaatcatgtatcatgaatacatattttttctctattgggatttgcctgtttttatgtatcacagccagaagtaatcactgcatagtgtatttctgtagaaagatagaagagttctattttaacacaatatttcctatatacccagcaaaggtctaggtatttatacatactattgtatttattcatctcatcaatgcaatgaagaaatattaataaatccattatatatgctaaaaggtagcgacacatatatgctacatgtgcaggttttctcaggtattattagctagggaagctgtgttgtaacaatcttcaaaaacttctttctattgtttacatgctattccacatcattttgttttcatttcttttgtagtatctaatgtattctactaaaaaaaaaagtagagtagttggaaaacttgtgaaaaaaacatatgtattacatatataccattcttcatgattctcaaaattttcatcattattaatgttttgtgtatatatatatatatattgtgtgtgtatgtatgcatgttagatatataatttaaaagaaaacaataagttggtggcttatggcaaattgttccttaagtcctgcatttgaaacatagacactgagtgaatcagcacatttgatcatcttttaactacaatagatgattatacattaaaaatacattaaccatccaaatacatcttttttcttatttatgtatgtatgtatgtatgtatgtatgtatgtatttttatttttttgagatggagtctctttctgtcgcccaggctgaagtgcagtggcgcaatctcagctcactgcaagctccacctcccaggttcccgccattctcctgcctcagcctcccgaatagctgggactacaagcgcccgccaccacgcctagctaatttttttgtacttttagtagagatgggttttcaccacgttagccaggatggtctcgatctcctgacctcgtgatccgcctgccttggccttccaaagtgctgggattacaggcctgagcctcggcgcccggcccaaatgcatctttaggaaaattatatttaagctcttcatggagacattaaaaaaccaagctgcattaataataaataattatatcattcattagtaaggagtaaatagctgttttctatttgagaagtattaattggattgtccatctgtatgcaggaacatctgttttctgacatgctttaatcaccatttgttttgtacttgtaccataattacacttgtttgtaatattgaaccgagacaatgattaaaatcaacttatgaatacgattcttttatgcttttgtatttcattagaaaatgtgtaattctggtatgacatttataagtatatataaaagaaagtatttgattaacaaaatgcctcaacagattatgtcagtaaaatgagtgttatatcatgcagtctatgttactattttggcatttttaaggaaagtttattgcttcacggaagcttttttttaactgaccatctatgaattttctgtattctttatttcattgtgatcacatggtcatagaagagacatttttagatcatcagaagttgacagttttcagtgtagtgtatgtgcttagtataagatggaattaagtttgttgtatgggtgattgatgaatttttactgaatcatggataactgctgttctattaatgacatttcatcaattaactcttttggatatggtttatcacaaaatgttgctgatttaatgtttgtggattaactgaggtgaaagtgatacctggtagaagtttcattaatacaaattttcctctcttaggagtaggatggattatattatttgtcgaaatgcctttgcatgtaagttcttaactgtcagctttcttgtcctgtgaatcatatcttttctgtatttgctgaaatagagacttaacattgttaaatgatttttccatgtcatggaaaatgtatgcctctaaatctgcgttccttcctacaaattacaagttcaaaatgactttttttaagaaacaaaaaaaaaagatggatttctcgtattttgtggcaggataagctccctgtagcctatcttaaatgttgattacgactaaaactatgaaaagtacaataagcaactaactgaggaatctgaaaagtaaataaaagtagaattatgagtgataggcaaaatctggagaagcaccctgcagtagtgtgagcttccattgttgtatttctttcaatcaaaaccaaaacaaacaaacaaaacaaataaaaaccagaaaagaaccaccaccaacaagaaaacactcaaggaaaatagatattgtgatagaaacagcagaaatgtcgagaaacaaaaccagaaggttagaattattagagaaaataatataaaaagtaattttaaatatctaaacaaaattttaaaaaggaatttaaaaaaataagcaaggagaagacaataaaaataggttgataattcatttgttagcatttgtctgtttggtatttgttgaccattttatttttaaaaaatttggctatatttgcttttggtgtatttcttgtatatgtattgtaaaatttagtatttattattattaaatattttatattgttaaatgataatttatttttattgataagaaagatgtagttttctggttgttatttttgtaattttacctgcatttatatttttctccatttatttagataatacctaatggttccccacaatgagtggcaattaaattagactctgtgctattttcactttctcaacttctcctgaactatttgatttttgtggcaggatatttcttaatatttgcctttgtgccacttaatgttttcatactattatgggcaaattttgagatttaaaatgaacccattactctcagctattatagacgaggcaatcagggagctaattcctactttcccctttcttttactctctcctcctggttgttacagttgaatcatttgtacattatcagaatcatcagtaaaatatctttttacatcttctacaccatgtatcccttaaatctatatatgacgcattgaatgcttacctcttgccttactggtagtattttacctactcagaactaggttgattgaactttgtcctgtggtaactctcttaataagaactttctgtaaagtgttccctgaattatgggtgcttataactgtacactttatagctgatagatatcttgcaaggataaggataaccatttgcttctcccttctcttctttctcaatatttccccccattttctggtgttaacttttgctgtggaaaactctgatgccaaaatgattttctttttctctaagttgacaatttttgcttaagccctcacataatgctttcttaatctttaaagtcctagtcccatacacagatatatcttggtgttgaacattctaataacatacataagcatatactacacagtaatgtaaatatatgtgcttatgatgatctatcttgtcttaatataggcaataacttttttctaattctatcctatgttttacagtttttggatttttggacggggagaggacttactacatattcttctctcacaccctttacgacccttacattatttggggttcagtctcccttgttctctttacaatttagtttttttttttttttctacaatgattttgtttttaaatcctatttctttcatggattctgccagttgctattgcactttctggctatctcttccccattctcttgcatttcacttcatggtctctttatgttttattacacccttaaaatttatgttggaatgtataaatgttcattccttttttcatctgttttgtagcaacatgtttctagttattacaagagttgatatattccttttttatctttattcttaagagtatttttatgtgaatgctgagaaaattcctttagtatttctcatatgtgaaagttgaatttcctacaggacaaaggaaaggggttgtagaatgtgccccagcctgctagctcaagggccctctcatcatttgctacagtgacagactgttgcctcattttggggacattatggagtcaccgctcgttctccataagagcataaatgattaccaggtagttgttactgtcttctctccttgatactcatacataactcatagcacatatggaagcaaccttctaaatacccatgttttatctttaaaatgttctttgtgtgtagctgcccatttgttttgtgctaactgactgaccctattaccttcagttgtaacaacccatttaaggtagaaacgaaggacactcatctccatgtgttttcagaatttaaatgaaaaaataaaaagaggctgatgtcacttcccagtttaacgcaggggttttatttatttatgtacactcaatcaaactatgactattacaaatggttttaccgctacaataaagatagttaattcataactcaataaaaatgaagagtgaaagattaaaaaaggaaagcaacaattctaaactataaaatctacttcagaaagctacatacagcaaagctcaataaataaattatgaaaaaaagaataatatgggataagttttatggtttaggagataccttcctataagccaaaaacctaaaaaaaaatgctaaaggtatagcttgctatagtacgtggtaggagaaattaacatgtataaaatcaataacactcacattatgtgatagtctacagccaaagaataatagaaagcaagtgaaatgcttagcatagctatttagtctactaaattaggtttgtgaaaatgggaatgccaaatgccttaaggcttatggcaggtgcaaaagcaaaacatcagaggtcaacctaaggatatttttaatataaaattaatgtacctgcattgtaagcattattttttttgtatggtagaaaggaaaaaattcttgtattattctactataaatgtgtattctttgctctactaaatttgcatgtcatcgtcagcctttcactttgtcttcagctaacaagaacctcttgggttcatcctttggagaacctgatatggaaaatggactgaactaggagaagagcctttgtttagaccacatgctgaggtctagtggcttcaattaaaaatatataaatgtggccgggcacagtggctcacgcctgtaactccagcactttgggattctgaggcgggcagatcacgaggtcaggagttcaagaccagcctgaccaacgtgatgaaatcccgtctctactaaaaatacaaaaattagctaggcatggtggcacgtgcctgtaatcccagctactcaggaggctgacgcaggagaatcgcttgaatcctggaggcggaagctgtagtgagccaagatcatgccattgcactctagcctgggacgacagagcgagactccgtctcaaaaaaaaaaaaaaattatgtatatatatatatgcttaatctctaagctttggaaggaacagcctatctacagaaaaatttaaaacttggtcatgacaggtacagagttgggccccattaattttgttgacattgaggtcagcagattctgtaaattttcactatacctctcatatgatctgccgccacaccattcatactcttaactttatttctcctcacaccagtaaattactaaaactgccaagtttttttttcacaaattaatatctttagcattctcctccttcagcctgcaatgaaattatctactcccctccctcctccttcctccttgactcccgctaatgcacatttgtgtttggtttccacaccaaatgagctaccttcaataagcatcccacaactccacagggaacttttgtttctctaccttctgtgctgtcaaagcgcttggctcagaatgagagatctgtctgcatttcagatctacaaattactcattgtgtgaccttggacatatccctaatatttttgagcctcagtttctcaaaaattagaataaagataccaaactcctggggttttgtgagagtaaaatgagacgatgtgtgtaagagactcagtgcagtgtcagtatctaccatgtgctatgcactctgcgttttctttttcttttttttttttttgagacggagtctcgctctgtcacccaggctggagtgcagtggcgtgatctcggctcattgcaacctctgcctcttgggttcaagagattctcctgtctcagcctgcgagtagctgggactacaggcccatgccaccacgcctggctaatttttgtatttttagtaaagacagcgtttcaccatactggtcaggctggtcttgaactcctgacctcaggtgatgcacccacctcggcatccgaaagtgctgggattacaggtgtgagccaccatgcccgggccaacccatagccttttggtcttctctcagccaaggcatccagtgaaaatgcaatttatttttcagattcctctggagaattaaaaagtctcttttgcggctggacacagcaactcacacctgtaatcccagcactttgggaggctgaggcaggcagatcacaaggtcaagagatcgagaccatcctggccatggccaacatggtgaaaccctgtctctactaaaaatacaaaaattagctgggtgtggtggcacaggcctattgtcccagctacatgggaggctgaggcaggagaattgcttgaacccaggaggcggaggttgcagtgggccaagattgagccactgcacttgctctggtgaaagagcaagactccgtctcaaaaaaaaaaaaaaaaaaaaaaaaaaagtctcttttgcatcaaattgccatactctctgctcttggtcctcttttccatgtactcattcttcaagcatttattttctcattgcctgatccagatcattgcaatgaccaaaaaattttcgaatgctatgatttttgtgatattcttttagcaagttaatcacgatgttgcattcttgagtgtgcaagtgtggaggtaagtcaggatgcatctttaagacaaaaagatgggtcacggcagtgccacaccactcacggccacaccaggagagctgaaggggcagtcaccaacgaagatgcctgacccagaagctggctgccagggagccaagagccaggtcactccacaggtggccaatgcccgggggtggccctccaccgccgaagctgctgctgctgctgctgctgctgcttattattattttgagacggagtctggctctgcctcccaggctggagtgcggtagcacgatctcggctcactgcaacctccgcctctggggttcaagcgattctcctgcctcagcctcccgagtagctgggaccacaggcacgtgccacctcacctggctaattttattttttgaatagacagggtcttgttatgttgcccaggctggtcttgaactcccgggctcaagcgatcctcccacttcagcctcccaaagtgccaagactacaggtgtgagccaccacacctggccaagttctacttttctaatatttaaaatatgaaataggccgggcacggtggctcacacctgtaatcccagaactttgggaggctgaggcgggcagatcaccagaggtcaggagttcgtgaccagcctggccaacatgatgaaaccccgtcactactgaaagtacaaaaattagccgggtgtggtgacagatgcctgtaatcccagctactcggaaggctgaggcacctaaacccgggaggtggaggttgtagtgagccgataccatgccactgcactccagtctcggcgacgcaatgagactctgtctcaaaaaaaaaaatagatgatgtcagtgatttctattacatgagatctggaagcactctgtacctgattgctccacgtttagtggtgctaagttcaaataattcaggtggtgagaaactgacttccgtaggagtgcgggtgtgcgtgcgtgccgcggaaatcccgccttctggcgcctgcggttgccccctggcctcagccggtaggctcccaagtaggaagataaaccgcattgcacgaagcgggagagtccagaggagcggcgaagcgctcctcttccccattggctgcgcccacggagccgccttgcgattggccctaagcgcgggtggctggggttgcgagaggcatcaggatccctggcggcgcctgagccagcggctgctaggaggctgtgtccgcaagccagcggggcgaggcgcctgggccctgcgcgtcaggtcccggcctggggcaccggggctgccagcgtcggaggaggtgcgggcgcggggttggcgggcggccgaacgggggcctgcgcggaccgcccgcggctcagcctccggtctctctccgtctctaagtggtggtggctgtgggtttttctgcaggtgatccttttgagtaatttgtttcacgcaggcgccctgctgtagggtaaagcggcagattcatgctgctgtcatttgtcgttcaaactgtgggcttcttggccaggcgcggtggctcaagcctgtaatcccagcactttgggaggccgaggcgggcggatcacgaggccaggagatcgagatcatcctggctaacacggcgaaacgctgtctctactaaaaatacaaaaaattagttgggcgtggtggtgggcgcctgcagtcccagctactcgggaggctgaggcaggacaatggtgtgaacccgggaggtggtgcttgcagtgagctgagattccgccactgcactcaagcctgggtgacagagggagactccatctcaaaacaaaacaaaaaacgatgggctttctgtcgtgtgtgtgtaccttttggatttgagggcagggggatgacattgtgatctggcctcctgagaaaccaggcacaccctgcctaccttggaaggcggctttcccttccccacctccctctccctccatctgttccctctttccctctctccacttcactcccgtcccccagctcttctctcccatctttttgttctctgtctcttttttttttcctgcattaaacctttcgggagtgtctttgtaaaatattaagaagcgttaggtcttcaacatgtgtgtttacttgcaggcctgagacctgggaggaagctggagaaaagatgccctctgaatctttgtgtttggctgcccaggctcgccttgacaccgaatggttgaaaacagatatacaggtggggtttgacatgtctctttcttggtgtatttctgcttccatgtttaaatttctcgtgtaaggcttttttttagggtatgtaaggggaagtcagttgtatcttgctatattagaggagcaggtttgtttcctgtaacttaaaatgtaacagtctttatggctgtttttgtagatcgtgcgcggctgccttttaattagtttcttgcaagtgcaggaaatgagatttattaatagggaaaatttttttcttaattattattactggttgagaaatctgctacactcctaaccatatcatggtgactgttgtttgttactgatagtttttgagctgttgagttaactgtcgaggggaaaattggagaagtaagttgcagtaattatggctgctagaaactcactccttttatgaggtcttgtgtttgtgtttctggagagaaaagagttagttcagttgagctgtttgttttgtatttgtaaccaatacaaggactaaggacaattgtgttgaaactgaggtcataatgttgggatcttaagggccgaaggttccaaacaaatggtatgtatagagttctctctgacttgaaattttccctttctggacctccggatgctgaggctgggagtgtccatatgacagtgccttccatgacaggagtcagcaacctttttttttttttttttttaacacgtatcagtaattcattctgtatattttgaaaagttttaacctcttcttcctagccctccagtatttgttaataaattaaaacgtttcccaaagtgttttttgtgaaacaataattctaaaagatgctctaagaaaagctaagtacatggaaaaatccaaagtgtatattttatttattacatttcatgaatttttgtttctgttttttcctcttgagagggagtcttgctctgtctctcaggctggagtgcagtggcatgatcttggctcactgcaacctccgcctcctgggttcaagcagttctctgccttagcctccagagtagttaggattacaggtgccctccaccacggccagctaatttttgtatttttagtagagacagagtttcaccatagtggccagactggtcttgaactcctgacctcatgatccaccctcggcctcccaaagtgctgggattacaggtgtgagccactgtgcctggaccacatttgatgactttttttgtcctttgttcttttaaaaatcatggttagaaagcagagcataattgttctttatgtagaatccaactgattggggtttttagggagatgttttgacattcagtaaatgtttttgttttccattattaagactatgaattttttattttactttctgagacagggtcttgctctgttgcccaggctggagtgcagtggcgtgatcttggctcactgcaacctctgcctcctgggttcaagcagttctcctgcctcagcctcctgagtagctagcattagaggtgcccgccaccactaccctccgcctttcaggttcaagcgatcctctgcctcagcctcctgagtagctgggattacaggtgcacgccagcatgcccggcaaatttttgaatttttagtagagacgaggtttcaccatgttggtcaggctggtctcgaattcctgaccttgtgatccacccgcctcggtctcccaaagtgctgggattacaggtgtgagccacatttttagtagagatggggtatcactatgttggccaggctgctgtggaactcctgacctcaagtgatcccctcaccttggcttcccaaagtgctaggattacagatgtgagctaccacgcctagccgtattttgtatttttagtagagatggggttttgctgtgttggccaggctggtcttgatctcctgggtgcaagtgatcctcccacattggcctctcaaagtgctgggattacaggcatgagccaccacacctggccaatgggaggtctcgcttcccttctctgcagcattccataagcaatgtgtttgggtagtatgtgttcgattttctctatgtatactttgaaccctacagtagtgaaaggaagagtagacaactttgaagttgatgtggtgtggtctttgagctggtggtgctaattactcttggttgttttcgtggcctccagtgacttcatcctgcttttgctgttgtaaagtgttgtaatttatgctcctgagaataactcttgaggtgtacttagggttcttgtctgcttcctggtgactgtcgaagcttttcatcttgaagaagggagatgagcagtgttccagtgtactgagattaaaattaagaatgttgcatttttttaatatgtaaaatttatagccagctgtagggtaggggtggcctactttctctaaagggccagatagtaaatattttaaggtctcactggaccctatggtctctgtcatagccatgagaccttgcagatttagtgccaaagtagccacagacaataccacgtcagcgggcaggggacgttcattctgtaaagtgtatttatggacaccaaaagatgaagtccacagaatgtttgcaagtcacaaaatactgtttttcttttgattgtttttcagttattaaaaaatataaaatacagtggccgggcgtggtggctcacatctgtaatcccagcacttttagaggctgaggcaggcggatcacctgaggtcaggagttcgagaccagcctggccaacatggtgaaaccccatctctactaaaaacaaaaaattagccgggcatggtgatgcacgcctgtaatcccagctcctcggaggctgaggcaggagaatcacttgaacctgggagaatcgtttgagcctgggaggcagaggttgtgatgagccaagactctgtctcaaaagaacaacaaaaataaaatactttctctgcgttcagaccatacacaaagaggctgtgggctgggtttggcccctgggctgtggttagtgaccccaaacacacacacacatacacacacgtagggcagagtctggcatttagagccagcacctgtgttctcacctgagctgtgttcctggctgggttctgctgtgtattctgtgacccaagatgtctatctaccttggtaaactggagacaacaaagcctgcctccttcaaggttgtttgtaaagatttaaaagggtaatgtattgttgttaggccagatgctttgcatagtacatgttaggttattttcactttttttttttttttttgagacagagtcctactctgttgtacaggctggagtccagtggcgagattccagctcactgcaacctctgcctcccaggttcaagcaattctcctgcctcagcctctcgggctgctgggattacaggtggctgccaccatgccgggccaattttgatatttttagtagagatcgggtttcaccatgttggccaggccagtctcaaactcctgacctcaagtgatccgcccacctcggcctcccaacgtggtgggattacaggagtgagccaccacatctggcccattttcactttccattagctgcttttttcccccattcatttcctacctttctgtgtatgatttctgaattaaatgtatttcatgtcttaaccttctgaattgtttgtcctctcattttccatgctgttaaggaaaataagaggctaagtgagacgtattaaatttgcatgtagtttctcagatcaggataaatgctcacctgttgcagaacgggactctgctcttgcttcacccaggatgcctttcctagttccttcctagagtggggccgcaccctgctccagccctccagacccagctccctgctctgacatgattccaccagactgtattccagctgtcctccctggacctagatattttccttcttcttctttttttttttttttttttcctgagatgaagtctcactcggtggtccaggctggagtgcaatggtgtgatctcggctcactgcaacctccgccttccaggttcaagccattctcctgcctcagcctcccaagtagctgggattacaggcacgtgccaccaagcctgggtaatttttgtatttttagtagagacagggtttcaccatgttggccaggctggtgtcgaactcctgaccttgtgatccacccgcctcggcctcccaaagtgctgggattacaggtgtgagccaccgcacccccccagccaacatatttttattaaaaaacttatatgaaatttattttattgtggtatgtagttcagtaaattttgacctctatagattcatgtaacccccatcatcatcaggatggagaattttcttcaccccaaaagctcccttgtgctgctcctttttatcacgtgttccctggtctcataccctggcaaccacggatctgttctccatcagtatggggtattctttttgagaatgtcatgtgagtggaaccatattttaagtaacattttgaaaccatcttcatttactcccagttatatgtttgagatttatgtgctgttctgtgtattaatagttctttttattgctgaatggtatttcatcatttggatgtaccacatggtgtttatccattctgccattgtaggaccttgtggttgtttccatttttctttcccaattgtaatcctgctgtgagcattactatacagattttatgtgaatatagtttccatttccctaggataaagacctagtagtgtgaaagttgggtcatgtgctgaactgttttccgaagtggctgttttagtttgcattcccactggcaatctgtcacgtttctgttgctctgtgtctttgttagcacttggtgttatcagtgttttttagttgagccattctaacaagtctagtgggatctcattgtggttttaatttgcacttccgtaatggctaagaatgctgaatatcgtgttcttctttgccactcttgtatcctctgtgaagtttctgttcagatcttttgcacggaaaaagctgtatcatggaaccagtaaaataaccaaggagaggttgattaaagttctgtttataaccctagaagattcctgccctagggatatgggatggctgaacgtaggacaccgacactggacagatgaaatagcagtttattagtcacgcatgctcacagccctggggtgggggacaccgcatgccattcagttaatcatgtgtgttgtaacttttcggggagggacatttgcagagactaatggtatgacattctgaaaagcggtgacagattaagaaattttttaattctgcagatggtagtgtcgaaccaagtggaacaaagaaagaagatctgaatgacaaagagaaaaaaaatgaagacgaaactcctgcacctgtatatagggccaagtcaattctggagacctgggtgtgggtcaagcaaccaggtaatctgagttttggcactttggaaagcttgatctgacgctccttttctaaataacttggatggattattcgtattttttggtaacaattttaaaaaatgtaattaaaaaaatttaaatatcgtggtaaaatatacataccgtaaaacttgccattttaatcatttttatgtgtacagttcattggcattaagtatattcacattattgcccagccatcaccaccatccatctctacaacttttgccctttctccaactgaaactccgtatccatgaaacactaactccttctgtccccaggcaaccaccattctacttttgtctcagaatttgactactcaaggtgtctcctataaggggaatcatacagtatttgtccttttgtgactgggttattgaacttcttaggtgtttggggttcatccgcatgtgtcagaattttcttttaaaggctcaatgctattccattatatatgtaagccacatgttatcccttcatcagtgggcaatcaggttgctttcatctcttgactgttgtgagtaatgctgctatgaacattggtttacgagtgtcttgagtgtctgcttttaattctttgtgtctatacctaggagtggaattggtcaataatgtggaatgcttacatatttattttttttgagatggcatctcgctgtcacccaggctggagtgccgtggcgccgtctcagctcacagcaagctccgcctctcgggttcacgcaattctcctgcctcagcttcctgagtagctgggactacaggcgcccgccaccatgcctggctaatttttttgtatttttagtagagactgggtttcaccgtgttagccatgatggtctccatctcctaacctcgtgatccacccgcctcagcctcccaaattgctgggattacaggtgtgagccactgcacctggccaataatgtggtagttagatttatgtttaacttattattgttgtttttgagattgggtctcactctgtcgctcaggctggaatgcgttgatgtaatcatagctcactgcagccttgaactcctgggctccagtgaccttcttgcctcagcctctcaagtagctaggactagaggcgcagggaatttctcatcttctctctactgcctctgagttggagatgtcagagggagccatggcccactgtaaagtaacacaatgtcctcacccacagggttagaacccctcttctggtggcagctctgaggggagcagtcacatgtggagagtgcagggctctgtgtccagctgggggaaggaggttaccaaggggattgacccccctctggccaggtggctgccttctgacacaccagtctctctctctagcacggtggcccctacacacccagcctgtcaaacctacagccctcgggaaggctttggccaaatccatgagcggctccctctgttaagaaggaagcacagctgaagcatgaggagggcagtagagtgtgtatgctccgccgcgtctccccacagtctgaccagaaggaaggggcctttcagccaggctcgcccaggctggggttggagtgtcagtatcaagccaatgtcttcttgcttaatgagtgagcccaggtgctcccgtgcagctgccaccgtagtgagggtgaaccggcaggaggctccacggcactttcaggctcaggctgcctggtgagatctactctgtgggctctgtaggctggtagaggcttccaggaggaggaggggatgcagccaccagtccccactcctgggagtcgtatttctgaaagcttgggtatacagtaaatattaggctgtgggctggtttatctatggatttgatgtgggagggttataggtacaagcagtttaaagatggaaattttgagagaacccttagtgctgggtaaggcaagcaggcttgtcaaagcagctcttttggggaggccagaatcctgtaccaatgtcctcagcatgttcatcagctgctgggggagtgccggacaggatgaaagcacaggagaactttgtggatgataaaatgttccatatcttcaaaggaggtgggttacatgggtaatgcatttgttaaaagtcatcaaaatgtaaaccagatctgtgcatttcacggaatataaattatacctcaaattagaaacatttttaaaaagacagatgggctggatgcagtggcacacgcctgtaatcccagcacttggggaggccgaggcgggtagatcacatgagtcaggagctcgagaccagcctggacaacatggtgaaatcccgtctctactaaaaatataaaaattagccaggggtggtggcatatgcgtgtaatcccagctacttgggaggctgaggcaggagaattgcttgaacccaggaggtggaggttacagtgagcagagattgcaccactgcactagagcctgggcaacagagtgagactccatctcaaaaaaaaaaaaaaaaaaaggttttcaacattcattaaaggcagagtagcttgttatagactagcctccccacaggaacagttagaaaaactggacaaaaatgtgtccccccttccccccaccatcaaaaacaattgttggaaggtaattggggacctcagccaggacttgagtgaccaggcctaggaggtgatcctgacagtccttagtgcttttcccacatttggtgatcggtcaacagtagagggctaagaggctaagaaactgagtatgaagtgatagttaagaggctggagagcctagctgaatgtttggcactctcacagggctgaaatgacataatgagaatttgggtcccagtaaggagatgagaccttggtggggatcctggaagggccacccctaagagtccaaaagaataaaaaatagaccagctgtcacaaaaactaaaacctgctttgagccagcttagtcccaaactagatgaaggcgatctgcttgaacgccaattgtgtgccataaagtcaaagtcagtactctctggaggcagataaaactttactaggcatgccataagacaagacaacgcaagacaaaaggagaaaacaaacaaaaaaaacaatagaaacatacatagatattagagtcctcaggtagaatttttttttttttttttgaaatgggagtttcactctgtcacccagcctggagtgcagtggtgtgatctcagctcactgcaacctcaacctcccacgtagctgggattggtgatccacccgcctaggcctcccaaagtggtgtgattacaggtgcaggccaccgtgcccggccagtattttgccacaatttaaaataaattttctttttttcaagtttgttctcagactgtattcacaaggtcacatggcggcttacacttctgtaggccttgttgaccgttctttttagatactgatgatcttgatctttttcttgtctcctccgtagaagaatgggatgcaggaggtgctgcctaagcctgggcgctcctgggcgttcttcattccagggggcagctgcatgatctgtgcagtgcggttgtcatgggaataacccttcccggcctctcgtgcaggctccaggctgccagggtggctcatatcagaaggatatttggagggagggaggcagggctctgagcaccgctcctcctgcgtcttctcctgctctcccatcctctccttcttctcccgcctcttctccacctgcctccggatcttctcctcctcctcctgcatcttctcatactcatcccacagcctctcctccttgaattgcagcctctccacctgcttccgcatctgctcctcctgctcccccatctgctcctcctgctcccccatctgctcctcctgcttcctcatctgctcctcctgctcccccatctgctcctcctgcttccgcatctgctcctcctgctcccccatctgctcctcctgcttccgcatctgctcctcctgctcccccatctgctcctcctgcttccggatctgctcctcctgctcccccatctgctcctcctgcttcctcatctgctcccccatctgctcctcctgcttccacatctgctcctcctgctttcgcatctgctcctcctgctcccctatctgctcctcctgcttccacatctgctcctcctgcttccgcatctgctcctcctgctcccctatctgctcctcctgcttccacatctgctcctcctgcttccgcatctgctccttctgcttcagcatctgcttctcctgcttccgcatctgctcctcctgctcccccatctgctcctcctgcttccccatctgctcctcctgcttccgcatctgctcctcctgcttccgcatctgctcctcctgcttccgcatctgctcctcctgcttccgcatctgctcctcctgcttccgcatctgctcctcctgcttccgcatctgctcctcctgctcctgcatctgctgctcctgctcccgcagctccttctcctggtcccgcagcctctgctcctgtctccacatcttctcctcgtgcttccgtagcttctcctgatcccgtagctcctcctgatcccgtagctcctcctcctgcctccacatcttctcctgcaaagtgttggtttgaacctcaaaaggaaatagagtcataagctaggtatataaatgtaatctataaaataacggttttcgtctatgattctttaaaaagaaattttaagccgtaaccctgaggttctgatttcccaggcatggtcccaatttgtagatttttagcacactctagaggattctgtggtgggaccagaacaaggacccaaattttccagctcttggctggagcctccccacaccctgcatgatccctagaccatgtcccagccggatgcggctcccacacccccggggctgccgccgctcacctgtggcagcgggattttgtccgtctccagtttcctttttagctccttgatgtggagctggatctcagacttttcagtttctaccagtcgaagtttttcttgtagttcggcatttttctccttcagctccttattggttatgctatggccggaggcagtagagaaaggaatgaacgaagaacagaaaggaccgctttggtgatcgaccctctaccctcgccccacaaccacagaaccgtggcactggaagggaccccaggaattaaaagtcccaggtggcaggccagagagaagacatgagttgcctgaggctaccccatgagtcagtggcacagccggcactggagcttccctgcacacacatgtaaacctgtatgaccccctaccatgctcacctgtaccccccacctcccagcacaccacccacgctaagggctctcagacctcccatccccccctcccctatcctacatgttcctgaacagctccagactcatggcttccctctcctttgttaactccttgatgtactgcaaacagagaaaggtcaagtcaggatacagcaggcagaggagcagctggacgaccagtaacgacagctacactgatactccacagtaacacttgctcctctccgtcacacccgacatgttctcaaggcgtttccaaacccgtggtgtcatttgtttttcttttctttttttttttttttttgagatggagtttcgctcttgttgcccaggctggagtgcaatggcgcgatctcaccccaccgcaacctccgcctcccggcttcaagcgattcttctgcctcagcctcctaagtagctgggattacaggcatgtgccactgcacctggctctcacttgtttttcggagaactcagtaagggtggaaggcacagagaaagagactgaattgatagctggctaacaggggcccagagcgatcagataatattgttattgctattactgttattattaccactgttggaacctttcttgagtgcttcaccaggcactatgctaacaatcccatttaatcctcacagccaccacaggagacagttatcattatcacctctattgtgtagatgaaaaacatggggtattaaaggttaagtgcttgcctaagatcacttagagctgggatttcaacacccaggtatatctgattctctaagcccattcttttggttgggggtaggggcacagataaggaggaggaaattaatcctttgttgatttttgaaagaatgatacattggcatagtccaaacctcagaaggtacagaagggaaatatcttcccccaacactgttcctctctcctgagttttttatgaatccttacaaacatgttttatgtatattaccataatacgtacgtacacacacacacacacacacacacacacacacacacacacgtacatgtgttccctctctctacacaaatggtaacatactaaagatactcttctgtaccttcatggtacaagtaccctcaactccgcctaggatttgaccaaggccacagccaagtatgggtggggtgggcacttggcctccgagctctgtgtccagtgctcgctccccacagcgccccgcaactcacccacagcagctgactcagccccaacctgcctctaacaaccacgcacaaaagcagcaagaaatggcccatgctgtcttctgggcaggacactgcatcctgcagaagggacctttaggctcattcctccatctgcgaagctgggctcccaggggaccgggtaggtggttggactcaccttgtccgccctctcgtgctctgcggacatagcagagagagcccgctgtaactctcctgcaaagtgccaggaatgatgcaggcgggctgccagatccttggaatcttctggaatgagagaggttgagctgcagcccaaaggcctgtgaaagtgccaggttgaaggatgacggggtgcccagattcccaccttcaaatttcctggcagcatcctggctgtcatggagcgctgtctccagttcagttttctgacacataaggattcgtatggtatgatcctgggcctttgggagacaagaaaagcaagtgctgaaagagaagcaaagaaaccttctccagaggacaggagggaacttcacaccctccactcacctctagctgcctccttagggcttgctgatgttggtggcttgccttattttcctatagaaaagaagaggaagacagagctcttactagagggaggcagagatggcacagcaagagacatgcccccagaatggccccactgtcccaggacaggcccacccatgggaccaggttatcagggaccctgtggggatggggtggaagctgggaggtgagccttcctccccaagctgggagtaggcgagacgagactggggcctctacatctgagtgccccccaaacccagcggtcatgtcgtgagcaaagaaagaaaccatgttacctctttcagctgagctcggttctgttgtttctgtggggagagtcaaaggaaggtgactgagggtggtccctcgactctattccccaggccaggaagcggtaggcaggggtcaggaatggattttaagggcaaagttctcagacccaatgggaacacaaactggtcaactttccttaacgcccaaagaaaaaggatttgggtctttgttggcttttgcccacagccacagaactgaaagtctgaaactagattctctggaaaagacagtaacataaaccttccgacataagagtgtgagaaaagcccacccttctgccagcttgtgatggagaaagatgtgttcattcaacaagcattgagcaagcacataggggccggggacggttcttcactgctgggatataggacggaaaaggcagacaggagcccttggccccaaggtttccattctagtgaatctttaaatctcagactctcagagcaaacagaacctctgatactctaactctacctcctcaggaaacggaagcccaaagaggaggggagcttacagcaggccctggactagggattaacacaaaaacaacagcaacaaatctgatttaagcttcacacatgtaagtaaaacattaccatccccattttacagatgtgaaaagagaggcccaaagagctcgagcaattttccctaaaccgtgtccctcgcagttggagagagaagtaggactcaaacccagaattcttagccagtacccagcagttcttccttccacaatcttaacagttaccctcgacctcccccttgtgccccttgtcctcaggagaccggccagccaagactcacatcctcaggcgagtggcagccccccgaagtggttgtctcagggttagcgccatgatttattttcttctttttggtgtcggttgctccggtaccaacaccagcactgttccactgatgatagtctgtaaactgtggaaaagaggagcagtgatactcatgagaactacaagctcctacagtcactttacagtttatacaaaatactctcatagacgatctgacttaatgccaccaacgactgtacgaggtgttgtcgcaatcacttagtgactgagagggattgataccatggctaaaagaaaggcaataatggaactgaaactcagtcttctgactctgagctctggggtgttgccacaaatcagcagctgccagagaccaaaaccagaggcagaggtagaaaagtaaaaagtaggcaggaaggtgtacactgtgtggtttacagtcgtacatcctcttagagtcatgtatcctcagggcagaaggcagcctttctgttaaatgtgggaattaaacagaaagaggacaacccaagctgcatttcagagagaagtcttgtatactctttgaaatctatgtgactatcatccctaagaacattaatgttttgtgtctcccacgagaatcaaggaaaactgatgcttcagaaagatgccccatatgtatcctgtggcactcaaagtaccccaggttgagatgagatgaggaagattcaagttgtcaagtccagtttcccaagatctcttgcacagaagatgagcaaatctcacttcaaagatcactgactgatgggcactctggtcccagaaccatggagaattcaaatatgaagtggagaacttagaaaaaactgttaaagtctctctggagagtagaagcctgggagaaaaccaaaccaaacccattatcccatcagtgctgtgcccaagttgcctctttgagattggcatggggtcacagggttgggacccaggtacttggagacgtgagcccaaagagcccagggaagtcaggcttggggcagcggtaggtgagggccgagtatggagtggggagccccaggagtcacctgcccaaagtcaccctggggtgactggtgagggcaggtgctggggcatccggttccttgggaacgtgagcccgaagggcccagggagatccatttttggacaataggaggtgagggcagagtacaaagcagggagccccacgagtcaccggctgaaagtcaccctggggtgaccggtgagggcaggggcaggactgctgaggggttggggctgacacaagattttggttgggggagcccagaggcactggggggggcccggccctgcgtgcctctggagtgacacggattctggcagctgttctgccatcagaggggacctggggctgggttggggttggggtgctgcaatccgatgcgttttacctttttcttggtcccagccaattttctttgttgggttttttcggacatcatggggtggggagggtggtggggttggggtcacattggcgtgatccaggcgaggacagtgatatgcctccagtcacgtaccacacagctatgtgactgagccacaggaggcgtcaccggggctgcactagaatgcggaaaaggggcgtggccttaatgctccaagcccattggtcaatgagaaagatgaaagggaaaggaggcggggccaggcagctgcgggtcatgaaggtcctgtgatgtcacaaggaaagcctcccatggaactgctgtccccgcccactctgggagaggggcggggctggctttcacttacttttttttttttttacatatataactttttattataatttaaggtatagtcgataatataatgtttttttttgttttgttttgttttgttttttttaattgatcattgggtgtttctcgcagagggggatttggcagggtcataggacaatagtggagggaaggtcagcagataaacaagtgaacaaaggtctctggttttcctaggcagaggaccctacggccttctgcagtgtttgtgtcccggggtacttgagattagagagtggtgatgacttttaacgagcatgctgccttcaaacatctgtttaacaaagcacatcttgcaccgcccttaatccatttaaccctgagtggacacagcacatgtttcagagagcacagggttgggggtaaggtcacagatcaacaggatcccaaggcagaataatttttcttagtacagaacaaaatgagaagtctcccatgtctacctccctctacacagacacggcaaccatccaacctctcaatcttttccccacctttcccccctttctattctacaaaaccgccattgtcatcatggcccattctcaatgagctgctgggcacacctcccagacggggtggcggccaggcagaggggctcctcacttcccagtaggggcagccgggcagaggcgcccctcacctcccggacggggcgactggctgggcggggggctgacccccccacctccctcccggacggggtggctggccgggcagaggggctcctcacttcccagtaggggcggccgggcagaggcgcccctcacctcccggacggggcggctggccaggcggggggctgacccccccacctccctcccggacggggcggctggccgggcgggggttgacccccacctccctcccggacggggtggctgccgggcggagacgctcctcacttcccagacggggtggctgccgggcggaggggctcctcacttctctgacggggcggctgccgggtggaggggctcctcacttctcagatggggcggttgccaggcggagggtctcctcacttctcagacggggcggccgggcagagacgctcctcaccttccaggcggggtcgcggccgggtagaggcgctcctcacatcccagacggggtggcggggcagaggcgctccccacatctcagacgatgggcggccgggcagaggcgctcctcacttcctagatgggatggcggccgggaagaggcgctcctcattttccagactgggcagccaggcagaggggctcctcacatcccagacgatgggcagccaggcagagacgctcctcacttcccagacgatgggcggccaggcagagacgctcctcacttcccagacggggtggcagccgggcagaggctgcaatctcggcactttggggggccaaggcaggcggctgggaggtggaggttgtagcgagccgagatcacgccactgcactccagcctgggcaccattgagcgctgagtgaaccagactccgtctgcaatcccggcacctcgggaggccgaggctggcagatcactcgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcggcacagcatcagagggagaccgtggaaagagagggagagggagaccgtggggagagggagagggagagggagaccgtggggagagggagagggagaccgtggggagagggagagggagagggagagggagagggactcactttctaaactttaaaactttatcaccttagttgaggtacaaatcctgttgtaatggaaaatttacagcgtgcttaatgattagtaaagcagattatattatccaacattccaataagataaaataatcacagtgatttctcttttttggaaaaagtttctcttattctcctacattattgttaagttttttttttttttaaactagagatatgtctaatatattttaaaacacaaagcttttgaggtgggtgtggtggctcatgcctgtcatcccagcacattggtaggctgagatgggcatatcacctgagatcaggagtcaagaccaaaattttagtattttagtgtgtattttagtatttattttagtatttaatacatcatttagggctacatgtagccacagaaagaataaatctgattcagtgacttaaagaaatatagatttcatttttgtcacttaaaacgtgcagaggaaggcagtccagggttcttttcagtttcctgatacttccttagcctggtttctattcttgtggtcacaatgtggctgctgtttttccaggccttggattgccttccaaggagggaaagatgaaaggtcaaaaggctgagtttgtctctttttagctgaaaaacacagatttctcaaaagttgtaaaattatactgcaattcaattttcatccttttttttttttttttttttgaaacgcagtcttgctctgttgccaggctggagtgcagtggcacaatctcggctcactgtcataatgtccgcctccatggttcaagtgattctcctacctcagcctccctaatagctaggaatacaggcgcatgacaccacgcccgactcatttctatttgtatttttagtagagacgagatttcaccatgttggccaggctggttttgaactccagaccttgtgatccgcccacctctgcctcccaaagtgctggaattagaggcatgagccactgcgcctggcctgcaattttcatcttttggctgcaaataagttatgtcactattctcagctgggggagtgtttaactcacatgttgcttcctctctgttacacaggttttaagatttatgaataggtactgaattgtatcaattgcttttttctttcttgattgagcagtgttttttcttatctttttatgttgataaggtaacttaacagtgattggcttttgaatgttgaacattgcattttggaattaaatcaactttgttgtgataaatgattaataccatattatatatggttgagatgggtttgctcctagttcatttggtagttttgtacttacgttcacaagagaaagtggagtctaagtttttctgtgtgttttttttttttttttttttttttttgccacggagtctcgccctgttgtccaggctggaatgcagtggcatgatctcggctcattgcaagctccgccttccgggttcacgccattctcctgcttcagcctcccgagtagttgggactataggcgcccaccaccacccctggctaatttattgtatttttttagtagagacggggtttcaccgtgttagccaggatggtctcgatctcctgacctcgtgatccacccgcctcagcctcccaaagtgctgggattacaggcgtgagccactgcacccagacttgtgaggttttaatatgaagtattaaagctatgctggttagacaatttgagaaatgtttcttctcctatttctgacagagtttatgtaagatgtgtgctatttcttccttaagcatttggaaagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctcatgaacactcctcaatttggagagagagggactgtgatgaggggggttgagatggtacccagagcctgatggccctcaccagcttcaggagaaacctgctcccctccagggctccttcctagggtccggcttgcactgcattctgggagaatcctgtagccccatcttccctttacccattggccgtttaatggtatcccattctcacatttagccttttgaatgaatcaaccaccatattaaaaaattaatagatttaatttttttttcagcagttttaggtttatggagaaattgagcagaaagtttagggagttctcctgtacaccctcaccccatttcccctgtttcctcattattaacatcttacattggtgtggtacattcgttaccattgatggggcagtattattattaactggagcccatagttaaaacatattggggttcactcttcatgttgtatattttatgagttttgacaaatggggaatgactcagctaccatgtctttgttttagtagatcgttagttgctttttgtcttattagctgactcttgttttgaggagaactttttgtcacatccttttgcaccccggcttactgtggcgtggggcaggggtactgggggccagctggtctctggggagcagcactcactgcatcctgcccccgccccattctgctcctttctggtctcagcagcctcccttgctcctttcacctgcctaccccagctcagctgcctgctgcttagatgccactgtggggcaaggaagctgcccccagtcggtccccgaggattctgcccagatagggataagaatcaccgcgagtgtttgctgagcacttgggaggcataggctcggcgggaagggaaggcctgcaggctgaggtggtctgctttgagttttgcagcgttgcctgcggtctccgtgggtgagggaaaaggcacagggaggtgcagaagcgttcctggcgccacggagccggtcagtgacagagccgggtctcaacccaggccactgccctcggcagccaagccccttctttattttggaatggccacctggccaactggcacacagggagaactcatgaaaggaggcgtggctcactcctgaagggagagggacacaggagcagccttgatgcgcaacgccccctccaggccccgagtccctgtccttggaggaagcaggactcccaggtgggagaggtgaagcagatggcttcccccactgcaaggaggaatcccggtgctcttctccaccagccttccctttggtcgccccctggcgtccgcgtcattgtgggaacactcgggcgggatgtattttaaaggagtgcctgatgcgtgtgggtgtggtggggttgggggtgggggtggggctgggggtggttgcagcggggcctatgcaggatcccggttggagggggctgcagaggctactgctgggcctggtgtcgccatggcagctggagagcgggcgaccggtcgcttggcgtcctgcttggggttgttgcccacatcaccgagcgaacgttcctgtcccgcccactcactgcgaggctgggcagggccgcttgccagttaattgtggggattattatttttttttttttgtagacggagtcgcgctctgtctcccaggctggagtgcagtggcgctatcttggctcactgcaagctccgcctccagggttcacgccattctcctgcctcagcctccggagtagctgggactacaggcgcccgccaccacgcccggctaattttttgcgttttttagtagaaacgaggtttcaccatgttagcaaagatggtctcaatctcctgacctcgtgatccgcccacctaggcctcccaaaatgttgggattacaggcgtgagccactgcgcccggccggttgtggggattatctgagagttgctggagtgttctgcacttccttgcgaaccttttacctgggtgggcagggggagaggccgagtcaagggaaggaggcaggatgccacacacgccctgcagggagagtcatctgctgggcactgcgacacacagaaagccaggagcctgagccccgcccgcggttgttgaacggagggagaatgaacaaccgctgacttcctggttcctgggtgccgcatcactgcccctctgctccgggtcaaaccggctgtatgcttagcttcaggaacatgtggcaggtggcagcccccggccccgtggcaggtaacggtggttttgcagtgtggcgtgctgtgggggccggcaggggcacagctgggcaggccaggctttctctggctcagtatgcagggctggttcttcccagaggaggcagaggtcagggaggagctctttccctgtgtctcctgaacagcttcatcagcacaccctgcagcggggactcagtgagcatcctgcagctgtcttgtcccagaagggctgtgtacttttggccctgagggcaacctctgcatttcctttctgggggctcccagatgagccccgctcccccaggtcatcctgatccatattgatgtgataaccccctcctcagtccgaaacatctggaggccccgtttgtccgtgggataagaatgggcttgagcatggctgtgggtgctccgtgtggcgacagtggcatgttctgtggcagcttgcttcctctgtagcccgatgtctttgactcccagcccgatgctccctcctcacccagcagaggcccctcctcggcctttgcatttgctttcatttatcttccttctttaaggctgcttttgagggtttactggccagcagcatcatgtgcagtctataaactgtgtgccctctcggggccaggtaggagcctgagagggaatgggagaagtggtcacgaatgattgtgaggactgcagaaagaagacagggctgagaagagtgtgatttcccctagaattcagagatgcctgcaccagctgggttttgaagaatgaataggagtttgccaggaagattctagaggaacaacagcaacaaaaagatttaaacatgggcacagaagaggtgaggcacagatggcacagggatttggggtgtgatggggcaaggaagccatgggcagggtctaggcccaggacctcaggtgctttgcatgccatgacttggaggcaatggccttgtcatgcagaactgtgcctccctgggccccattagagtccctggctcttggtgtgcctttcatgcccacaccacggtaggagcaggcaggtggggtttggcctgggtttccccaaaatggacactactccttcttgtgcttcagtatcagagtgggcccgtggagtgggaataaatgtttgggtttaggaggcctccagctgggtggcctgctcccaggcaggaaacacagattagaggaagtatcaagttggaaggcagcagccgtggatgttaaagctggaggaacctcttaaggaatggctgtcagctccctcgtttggtgtggtaggaagatgagggtgagaggggttgggagcaggtgctggagctggagcctgaacccccatatctcagtgctgccatcatccttcataataaggaaactgaggcacaggcaggttacatagtcttctcaggatgtcagtggcagagctaggacgtctatctctgcagctcagttctgtgcgaagtccaggcagatggtgctgatcagtaaggggtgctggctgagcgctgatggccacctgcatctcaaggagaaacagtgtcactggctaatctgatggcttctctgggcaccagcacgtgggcaccatcaccctttctctgcagggggtttgtttagtgtatttggtagaacatcccccagcctactaggtgtggcatgctctatgccacaagctctgtatctcaggcagcattttgtactttgaaaaaacaagttgggaacagaaccctgatgaatgtgtttcatttcctgtcagagcaaatgaaacctgaaatattaatggcacgagatttcccttatcttcctacaaaatcttcctacattgaaaaatgtactccccacaagcttagcatgcagctctgctacctgtggcccgaaatcattagttgtccatactcactgacctttggaaataaacacgaaggttcacttgaagacttgggggagaatcacggtcaacttgtgacgcttggtttttcagatattcagctgctctggagagccttggagttccagctgctctagaggttctggggagggagctgttagcctcccatatgagcgtgtggcccatcgttgccatccacacctgcccctctgtgggtgaataagtggtttcctttctcagctggttgacgcttcatttgtttgtgttctttttctttacagtctcctgaatatttacgcgttgctgaatctcctgtggacaaaccaccaataggccaggactgtcctgtggacagacggggtgagcctcttcttgtgtctggagattctgagtgagtagaacccgttatgatccccactgcacttaatgtggcattcatgaatgagtctgggctgatgtgctaattgggggccgtaagaagagttatagccacgatggccctcacctttctctaataaaagcttaaacacagctacggtaaatatttttgctttctgctttcacaaacttcacatacgcttacatttattttgaggcgaaaggggaagaacagacatttacaggggaccagttgctaggagaagactgtgcattccctgtaaccctgtcagtctcacctcggagatcctgtccctggagtgccccaggtcccttttcccagctgcactgagtgcctctgtcctcctggtggagctgtgctgctttcttgggcagcctcccttccccatggggtgcacataggctgggggcatcccggtggtcagttcttcccagggacccaggaggaggggctggcagaaagtgggcaggttctttccgctcgacctggcaataacaattcctaaattgctcagcaccccaggctgcttgccttgacccaggtagccagtcccaggcaccaccagtgtgggcagggccctccccaggggcagcagcagggcagcccaagacactggtggccaccacagttagtccccacaaggcgattgtgcaggacatgttctcgagctgcctgcagggtctggttgtgggagcagctcagcccctcctgcagaggtgggagcatcttctacagccagccattgtcccgcaggagctctgtgcccagtggaatatctcagtgcagtgcacaatggggccacagctgtgtcacagccatgctctgtcctttagtgggccgtctgagccacattccacctgcctgttctgacacactgctctccctcgatgaccctgctcccactggcctccccatggtttcgatctgtaacccagaccctgttcccaggagctggctcagcaccatcctgctccacaccctctctcaggagacatcctaacctgcccagcctgtcctgttcctgcctctcaacccagaacactgcaggtccttcaggtattcggtgagaccttagaagcaggcacagcaggatttatcccacatgcaccatgcaccgtgctgaggaagccacggtcactcccctaatggtcactagaggtgagagaactgaggttgttgcccatgtggtagaactggaattcagggcctcagccacacctcagtcaccacaccacgccctgtgcaggacgctggggaaaccaggcagctaggactggcctgtgccttggaatgcttactcagaccacccatccttgtcccctttgcacctcaaaggcttggtctacttttcagacacagtttttatattgtcagcctgatacatatgcatattttaagatgtcaaagagttttataagttttatgaaaaaaatagcagacccctggcctcccagaccatctccccaccgcccctgccctgcccactccccatagattaccacttccagctcttattgcttcttcctctggatttatctccacatttgtaaagaatatgggcacgctgctatttcttagtcttctgttgtggtcaagatggttgaactcgtagatttccctcctgagagctgctccatctaaccctaaccctaactctgatatatagagttatgtcatcatttaggtgaacccttatgcagtgtgtatcagtcaggataggctgcctcatgatgcaggaacaagcatccccagacctgagagagttccgtttctctagcctcctgccctgggggtgggtgctgagtctgggggaggtgtggggtggggggaggggcctcagcgctcagcagacaggtgctcactggtgtcaccatgttccctgccctcttctcatatggaacacgtggtgcccttttgccagggcatccctgctcaggggtcaggatagtcctcctctgagtggctgggagtctgactgctccctgtttagactattgagtagccccctgctttctgcctcactccctttttgtgctggtgtctcagtgcttgggccttttggggttttagaggtgggccgtgaggctgggcatgaaaaggcttctctgcctccaccgcccccccggggctcctcatccctgtgctgcctcagcacttcgtctggcaagatttgcaggtgcagttttcatttctcattctttgttggttttgagtgatttcaagagaagatgcagaaaggctgtgaccccacctctaaaagccagcggtcaacctggccacccttaagcctgttctagtgggccccctgccccgttgccctgctgtgacagtgtcccacgaggacagactcaacacaggacttcagtccttgccttcccgagtgctggcagccctggtgctgttgctttccctctcccctccttgttctcaacctcaggaggaaaatgcccagtttctcatgatgagatatgatgtcatctgtaggttttttttttaaaaaagtgggtaaaattcatataacattagccattaaccagttgaaagtgtgtaattcagtaacatgtagtgcatttgcagtgttgggcacccactatctgtgtctagttccaacaagttttcttcatcccagagaggaactctccattaagcagtcactccccagcctccctaccccagtctctggcaaccccaatctgctttctgtctccatggacttacatattctgaatgtttcccataaattagacatcatataatttgtgaccttttctttctggcttctttggcttagcatgaagtttatgtggatgacccatgttgcaacatgtgtcagaacttcagtcctttctaaggctgaacaatattgcattctgcagatacaccacatttgtttgtgccttcatttgatgggcgtttgggtagtttccaccttttgactgtcaggaataatgcagctgtgagtgtgtgtggatagtgttagattcggtatctgttttcaactcttttgtgtatgtatttaggagtggaattgttgcgttctgtggtgactctgtttcacttttccaggaactgccaaactgttttccaccacagctgcaccgttttacattcccgccagcactgaatgaggattctcattttcccccatcctagccaacacttgttagtttctgttttttgtttctttgtttcatgatggccagtctatgggtgggaagtggggtctgactgtttattggcatttcctgaataggttttttggtagatgttctttatcaagctgaagatggtctctgcctcatttagtgagtggtttttaatcagaaatggttgttggatttttgtcagatgctttttctgcatcaattgatctgatcatatgattttgtctctttagtctgttgatgtggtagattatatccattgatttttctaatgttgaaccaacattgcagccttggaaaaaataccacttggttgtagtgtataattctttttaaacgttgttagatttgatttgctaataatttgttgtggatttttaagttgtttgctcctgagaggcagtggtatgtcattttcttataatttctttggttttgatgttaggataattccagcttcataaagtgaggaagtgtttcttcttttccaatttctggaataggttgtaaagaattggtgtaatttctcccttaaatgtttggtagaattcaccagtgaaatctatcttccttttactgatttttagtttaattctattgtagtctgagaacatatttttatgatttctatttttaaaatacttgttaaggtgtacttcatagctcagaatgtggtctatctttgtgaatgttctgtgcaagcttgagaagaatgtgtattttgctgtagttggatggaatattctataaatgtcaattctgttgagttgatttatgatgctattcaagtgaactgtccttgttgattttctgtctgcttgttctatcaattactgacaggtcttgaagtctccacttataatagtggatttaccaatttctcatttagaattaaaattctctcagattttgccccatatatttcaattatctgttgttaggtgcatagcctttaaggattgtaacatcctcttaaaaattgatttttctctcattatgtaatgtcgcctctttatccctgataattttccttggttggtagtctgctttgtctgaaattaataatggtactccaacttactttgattagagttagcatggtatacctttctctatccctttacttttaacctaccagtgtctctgcatttaaagtagatatcttgtagatagcatagagttgagacttgtgttttttatccactctgaaaatctctgtttcaatgggtgtgttttgatcattcacatttaaatgattattgaggtacttagattaatatcaaactttttagtaactgtcttctgtacttgccagagacttctttttctctctcctctggtttcaatggaccattttatgtgatgccattttatctcctttcatagtgtatcactcatacttctttttaaaagttttacaatatatgtttacaatatgtatttcaaaataatctaagcccaccttcaaataacactatacctcctcccatttagtacaactaccttataacagaatactcccaaatcctccttcctgtcccttgtgacattgctgttaattatttcaattatccatatgtcataatcatacagtatatcgttaccattattgcagtaaataaatttatttttatatcaaataagagtaaggaaaatagaaaattttatttcactgtcatttattcctttttgaatacctcttttttatgtagatccaagttttcaacctatataatttttcttctgtatgaagaaaaatcttttaacgtttatttcagggtatatattgccagtaatgaattcccttggttttgtttgcctgataaactatttctccttcatttttgaaggatactttttctgaacatagaatgctaggttggtggtttcttctttcaaaattttaaggatttcactccactctctctctctctctttttttttttttttttgagacagagtctcgctctgttgcccaggctggagtgcagtggtgctatctcggctcactgcaagctctgcctcccgggttcatgccattctcctgcctcagcctcctgagtagctgagattacaggcgccagccaccatgcctggctaatttttgtatttttagcagagatggggttttaccatgttgtccgtggctggtctcgaactcctgacctcaaatcatctgcctgcctcagcctccccaagtgctgggattacagacgtgagccaccgcacctggcctatccaccctcttcttcctttactggtttctgatgagaagtgggctgtaattcttatctttacccctctatagataaggtgtttccctaccccgctggtcatttgccttagtcattttctctgtctttggttttctgtagttcaaatatggtgtgcctaggtgtagggtattttgctttttgttttttttttgttttgttttgttcttagtatttactctatttggtgttctttgagcctccatggtctgtggcttggatctgtcattaattttgaaaatattttggccatcattacctcaaatgattttcttctccattgtctcttttgttcccttttggtattccagttacacgtgtaacatctttgatgttgttccacagttcttggatactttgttctgttcccctccccaacccattattattatttttttatttttatttttttgtagaggtgggactttgccatgttgcccaggctgatcttcaacttgtgagctcaggtgatccccccgcctcagcctcccaaagtgctgggattacaggcatgagccgctgtgcccggtcttcccaccattctttgtgtgcatgtgtgtttcattttgagaagttcttgttgacctgtcttcaggctgattattttcagccatgttgatgagcccgtcaaaggcattcttcatttctgttaataggttccttttgggctgggcgcggtggctcacacctgtaatcccagcactttgggaggccgaggcgggcggatcacctgaggtcgggtgtttgagaccaatctgaccaacatggagaaacccctgtctctattaaaaatacaaaattagccaggcgtgatggcgggcacctgtagtcccagctactcgagaggctggggcaggagaatgacgtgaacctgggaggcggaacttgcagtgagccgagatcactccactgtactccagcctgggcaacagagcgagactccatctaaaaaaaaaaaaaaaaagaaacatgttgtcctttttgtcttctagcatgccttgtaagttatttgaagctagatatgatgtatagggtgatgggaactgaggtaaacaggcctttaacgtgaggttttctgttaatctggctatgggctacgtgtaatgtttgttgtagctgtgagtgccggcgtattccgatccttgcagtgcccttgtttttgtcctctggctctgggcttccctaaattcccttcctcagacagagtgagtgtcgtgcagctctcccagctttcacctgctgttgtacactggagtcctgttggtgtagttgtagggtgtggggagggccagcggtctatagtcttctgattacatctcagtctttctgtggtcccatttccctgggctgtgactgtcacagatgtttcttcttatatagcttttccagaccccaaacaggaggccagagggggctggactcaggaatgcccttcctccgtggctttgcaacaaggttctggtaaagtctttccctgcggggagcaggcctttgtcctagagaaggctctggatgcatttcaccaggatgacgtttgtcctccctctgccagagtcaccaggagatgtctcttgggttttcatggtgagaacctagtagggatcctggaggaaaagcccatgaaagttttgggcccccctaagactgtggcttctaggagtttctcagtcatgggagtccacccttggcctgcagcaatttgtcagaattacccaaactactgtggtatggccctggaggctctgttccaggtcagtggatctttggatttggctgtgtctctagatttcaggggggcgggttgcaaactcaattcactgatgagtccaaagaaggtcattgattttcagtttgtgcaccattttctagtcatgaggatgggagtgatgacttccaagttctttacgtgttggagcggaaactccaatccttcccctgctttgattttcctgttaccctaaccgggaatcatgtttgttatttgatggtttactcagttgtcatctgtcttcctaattaggacataagctccagggaactggagtgtcagtgttcccttgcgtccttgcacccacaagacagcctggcacattctgaatgaatacaccgaaagggataaataacgaggccaagccacctggctatgggtggctgctaatccgtaggatttctcgtgccttgtggtttcagtgaatttgcgacacacatgagtgatgctgccaatgggaggctcccagatgtcctcaacaaatagaggagtgaccactcagatccaagggtgtagcacttcccgcctatcactgggagctgatgggctgtctttagcatggcactttgtatggtgctggcgcccaggcttccctggggcaacagcgttggcccaggcgacacacaagaagaagggggtttttctgtggtcacttccgcgttgctagttgttttgccctcttactgtggctaaaccttctgtccatacctgtcccccattctcagtatttggcttttcggattgcagtagtgggacttgggtgcacattgcaataaaccaatttgcccccattatccatgtcttgttgatggtcccactgccagcatcagttcttatgaacagatttctaaaccatcaccatctgttctgctcttaatttcaagtgtaaaaagtattactttcctaattccgtcaaggggagggagaatatgtattcctaaagaccacagttcttgtatgaggaagtgtagatctgccacccacctactaaaggaaaggttgcttctgcccatcctcaaagctgttgagcagttatttacctagagggtaaaactggcccattcgcatctctataaaaacaggtaggaaaaggtggaaggagctgagttggggaggtggaaggggggcaaaagctatgtctcccgtccctccctgacagtgcagccccccaaccctccagcccccgccagtataggtgggaatgggctggcagggctgcattgtggtggtccctgctgctgctagggctgtttccagaagaaggcccagtttcaggcttgacttcccctcagaagtcataaggaccataaggtccatctgggtgggcgctgagctctccacgatgggagcaggatagacatgagcatcttcaccctcgtggtccctctgagcctgccctgggggtgagctctttttctgctcaaatgaacattccaggcaggccctggagctttctgtcgttctaaggcaatagaaggttctttggttactttcagtcccaggaacattgttggtcagtcatgaaaaggagtaattatagactctttggagcttctcccacccggctggagcctgacctgtcttggagccggctggggagggagggctgtgtgtctccttctttctttctttgcctctgtttttgctggccagggagtgttccgagggatggagtgtctggggagagggcattctctccacaagtgggctgggtggcacttctggggtccagcagatgtttcacttggacttcctgtctccagtgaccctcgggtaggtttcttagagatgaccctgctgggaacttgcagctcttccctgcgacctgtgggaggccttgctgggctgatgcccttgactgctctccctatcctccaccatgcccctcgggagtgctcctgggctgttccttcaaggcggccccaggctggccccacactggtgggagcagcaggcagctcctccttgggcagctcctcctcttcccctgtgaggcagctctggtcatggcctcctgcctctggattctcaggaaactcgggtgccgcgtccgcagacattggggactcggtacagctatcctaggggtctgctagaagccctgtttgggaatcatggtgaagccacctccccagccccctccatgaggcacagcccttcacggaaagtccctgctcctcttctggtaccccgtaggccagaaaccatgctggggtggggagctgggagcatctgttgatgtgggatgcaggcgtgcttgtcacctctcctggccctcagggcagcaggacagcttacatgaacatctcatcccgctgctggtggcctctggtgagagactactccagtcggtccccctgtagctcctggatcttagcgggggcctgggaatgggaggccacaaggaggttccagagctaactaaagccgctgagactcagagggagtctcacgccactgcctcctgtgcccccatcccctagcaaagtgggactgatgagggatgaccttgcgtccttctcccctgttcactgggacctggtgctgttgccaccgtgggcccaaacatccactgcccttttagcaaggcagcgctgctccatagggtccagccggggaagcatctggctttgcacaggtggaagatcatgactatttccagagtctgttgccaggctccatgtagttcaggagttgtttctccctctgagagtccaaagtggttgttttccggagtttggcagtacctaagggttaattgggatgttattgtctgcatttggcttagagataggaaagttttatgtttattcaaattatcagtaatttaaaattacaattttagtcttaattgtacgtatttggagatcccatttaagtctttggaaataattgcagagtaatattttgggaagttatattacaatgcacagacgttcaagtggagaaaggtccctgcgtgtgagccttggcctggcagaggggcatccaggacaggatctacagcacacagccctcccaactgggtctgggcatggctgcagctgagtctagccctcctttctgtgctgctgcatcccaggggatacggccacacaggccacagttgcctagaccgacctggtgtcaggatcactgtctctgctttggtaagatgtccttgggaggggaagggagccagccaatgagatgaggggtaggagggtgacagggtggagcagaccctcatgctggcagaagagaggttcacattcaccagggagcaggtttttctgaaccctggagagctgaggggggcacctggagcacccctgcagtccacagcatggggtgctggcttctgtactgtagtgcagtgccatgaggtacccatcccttgcagtggggtagggtttaaaacccagaaggcagccctccctggagcacagccccatggtgtttagagaccctctcctctgagcacatgcaggatgtgacaatgcaggtgggcctagtgctgcagtctcagagacacccatgggcttctgccatgctttttatccaccagggcagtaaaagcaacgtccacagtggcttagcctcctgcaaagcctgtggcaggacagccagggttccctgacagtggagatggtggacggccccatagggggttggtcccatctcgccagcagaagtgacctgtgtggccttagtggtcagtgctgcctattgtgatagtggattgtttaaagccaggtcccatcgtggctcctgagggaatgaaaatgaggggttctttgctgtgatctgatgcttgtgttccaccaaatccatattttggaattcttatccccaaagtgatgggacctttgggagggagacattggaattcacattcccaaggagatggggccttatggaggtgtcttaatctgtattctgctgctgaaacagaataccacagattgggtaatttataatgaacagaacattatttggctcagagttctaggggctgggaagtccaaggttgagggttgcatctgctgagggccttcttgctgcgtcctaacatggtggaaggcatcatatagtgagcgagagagggaagggggccaaactcattgttttattaggaacctgctcctcagtcactaacccactctcgcgataatggcattaatacattcatgagggtagagctttcaggacctaatcacctcttaaaggtctcacttctcaacattgttgcatcggggattaggtttccaacacatgaactttgggggggcacattccaactatagcagtgggtgatcaggtcctgatggtgaagccctcataatgggatcaatgccgttttaaaagaggctgcagagagagcctcccgccctccaccatgtgaggacagagtgagaagctgccgtctctgagccatcacgcaggtactcaccaggcacggaatctgctggctctctggtcttggacttcccagcctcctgaactgagacaagccactttctgtcatgtataatctacccagtttatggtattttgtgagagtaccctgaatggaataagactcccttcaaacaaatgtcctgctctttgaaagagagtgtggggctcacagtctgctagtaaagacagttgtaggagcaatggcaagcccacactggctcggattttcagaccttatcattgagttaggagcgaagtcctcgacctgaggttttattggtccaaagtcagggcctgctggagcccgacaggttgcgtgcttggcctgtggagcagttttctccagagcacctctatcccctctgccttgtgccaggcccagcagggactgagggtagaataatgacaggcacagctcctcccctcaaagagtccactatctggggtttgatgctggagcgcaaggaggggctgcccacatgggcggagcagagggcctggggaagttccaggaagaagtgactgtgtgccgaggctgcaggagtagaggcagcccaggagaaaggggggcatgggctggaggtgggggtggttccaggcagagagagcagcttgcacacgggaaaacaaggcatggagtgggcagctccttccgcctggtctctaaacctgtgaagagggggctggggagaagagacgggggtggaggagagcaggactcacaggccagccagccctccacagccttgggaacagagtgaagagcttggactgtgtcctatgtcctggggccggtgccactgcaggctttggagccaggagggactcagtggagcttgctgtgtatgattgtgagtgtggggaatggtttggggtgggaggcaggacaagcagctgtggactcctgtctgcaggtgagtgccagggctcagtgtgggttctgattgggctaagtaggtgcccatctgcctggagtccagctgtccttgtgtggtctgtagaccttgttgtcaaggtctggcagctcaacgctggtctttctgagataatgaaaagggaaaactttagaggcaggacgaagaccttgtagtgaccagtgacatccccacagggtctaggtgtgcgaggtctattggcgcctgtgtgggaaggcgggaaaccaggggcttggggccagctacaaatgccacactgggctctgccttggctctaggtgctttggttgctggatttggtggtggctcagggcagtcacttgtcattctcagtattttatcccctggggcctcctcagagccataggagatggttcacctctgaaggactgccccatgctgtgcttggtaagctcggtcacccagggctgtcacagagatgggctatggcccacatgggctgagcggatttctgccctgccacctacaccttgctgtgattactttggcagtgtttccccgtcaggagagcaggtgggaagggaggcaggtccctgaactgggatagagcccggagacctgggtgtcctctgctctgttgtactgacacgctgcgtgcttatgaaatgagggcaggggttctcagtgctcccatggcatggtgactataatccatgaatgatgcccacacagttcctggcatgctcagtgtagccttgttgttgtaagagaaaaaagcagggattctccacttccccacagagtgaactggaacgaggagagactggtatttctccaacactaggtttctttggatttttatgctggttgatactccctaaatcacaggtcgccttaaagagagcaagagccctgcacggtggcccggacccttggggccccttccatccgatgcacctcgtggcccagtctttacctgctcaccatgcacagcacttcgcatgggtttggaaacgtgtcatctgcatggcaaggatgggaatggggagtgggaacctgcagtttagggtccaggcgggtggattttaatttgcccctgggggattctagggccagcagagctcactgccgctgctgtctgggcctccaggcagtgagctgctgggggagcccctctggaaatggacagtggctgtcagggcgtaggacgctagggggcgaacagaggaagtagaggtatctggggctgaagttcaaggttgcagcatgaagttcagggttgcagcgcccagcctagcagggcagggttcaatctgcaggactggcatgaggaggcagaggagtcagccaagccctcccctcagcctctctccagacactacagatccaaggccaggtctgcatgaggacagccacctggtctcggctgaggttacaggaagggagtcggggcaagggccagtgagtttgttcctaatttgggtcccctaattgtccaagagaagaagaaaaggcctaatttctgtttcgctaagttttagactactttagttcatgttctttaacaataggttattcatgcagagctcatctctattaatcaaaatgtatgattaggcagaaagccctattcccacaccagagtggtgaaatgcagtgcatgtgtgttcagatcaatttttgaagtcttgattttgttttgttacatgtttatttgattgcttgcagaagaatgaagttttttggccctctggaaaatttttctttctcctgagaggttttccaatctagtagaaaatagacgcagagtttggcttgcactgattgcggcattagaagcggccctgtacattttaatgtggaagacgtgatggttttgcgtttgctcctccagttgtgccccatagctgtctttctgccagctctcttgcacatttagttcttgagtgagatgttctaaatagaagccatggtccattcagtccccagcctgctgtccttctgtgacccgccagccagctttgcttagggagctatgagcccctcctactaggctacaaagtcatgggcaggaaaagcatttgtgcacagccaggagcagagcacccaggcccaggtctgtcccggagccatgtggacctggcgaatggctgttcaggtcagaagggggtttggatacaccggttctgtgtttcggaggccagcgtagtccccagtgtatttcgcagaagtgatagcagctttattcccaaggcactagtgcctgcgcgttaggcacgtgctgggtgcctgcttgagtgtctcctttgttcctctctatcactggctgtcccctgcagaggcaagcgaggcagagagttggctggtaacagccagtgtccgcagagccccagggctccctgactgggctgtgccacctggggacaggcagatagaccccaagtaaagttaaagggaagcacagtggggcctgcacaggatgtgagttggaggctctggtgaaactgagacttggtgggggatgggaggcaggggccctgctgggacagacaggagaccaggggccagtggcagaaatggtcctcgatctaccctcatgcagatggtggcctctaccgggagccctgtgtgtctctgagccttagtctccctccctccagtctgcgaaatgggcataatagaaatgatgcctctcactaataaatctgtgcagaaagagaaagcagtttgcaactgcaaagcattattcaggtcttcctggctctacctccaggatcgtatgcctccgctctctcacgagacacaggcctcccatgtgcccggtggtggtctcgaggtcatctgagccatcatccacccctctataccggggacagtgtgctgccaggaggggcaccagaagaggtgtcatacagtggcatgctgagctaggatttgaggcacttcctgcctcttctagttccttgtgggccgggggtgctttgctcagatggtgctggggaggaagggcaatatctaaggatgtattgagagggtcacattcaggtgtgccatcttctgagggacagaaccctgtcacgacagttttgccgtgactgaattcccacattgcagagtgcgcttggggtgtggctctgaacatcgctggcaggtcaggtggagcctcgctgctctggggagctgtgcccaggttccctcggttcctgaagctcagaggttgcaggagaaagggcctcctggtggctgcttactctgccccactgtgaagtgcctggtcactagagttaggcctctctcccactccgggcttcagggattccactgaggatggagggtgttggatttagtttcttttttttttcttttttttcttttgagatggagtctcactctgtcgcccaggctggagtgcagtggcaccatctctgcttactgcaagctccgcctcctgggttcacgccattctcctgcctcagcctcccgagtagctgggactacaggcgcccgccaccacgcccggctaattgttttgtatttttggtagagacggggtttgaccgtgttagccaggatggtctcgatctcctgacctcgtgatccgcccacctcggcctcccaaagtgctgggattacaggcatgagccaccgcgcctggcccccttctggagtatttcgttcattagaagtaagtcagggacttagtgtctttagctccagccagtcctgtggcctctctgccactgtgtgaatgtccccaaccccccacctgataagcaggtgtcctgaggtcatcagggatttggacttagttattaaaaagcaaccagcacccttaggagcctccagagcagagattgccaaactttctcagaccacggtgccctggatctcagcaatttcatggtgtttctagaccaaaacacatagctaacaactctactctttaagtagctaggtccaaaccacatggtatttatgtcccaacaacttggaagccacatgagaaataatactcataaattgaaacaaatgtatttcatcctaaaccacaattacaaacggaagtgtgtctgctgaatgagattggcaccattctcatttcctgtttgatgctgacttttgtgtgggacttgctgtttaaaagtttatttttatttttaatttttatacacatatcatagttatacatattatgggggtacgtgtgatattttttcttgagacagcgtgacagagttttgctctgtagcccaggctggagtgcaggggtgcaatcttggctcactgcaccctccacctccctgttcaagcgattttcatgtctctgcctcttaagtagctgggactacaagaggtacgccacctcgcctggctaatttttgtatttttagtagagatggggtttcaccacattgtccaggctggtctcaaactcctggcctcaagtgatctgcctgcctaggcctcccaaagtgctggaatcacaggcatgagccaccgcacctggcctacatgtggtattttaatataagcatatacattattaattgtggcaaagtacacataacataaaataccatcttaatcattttaagtgtatagttcggtggaattaagtacatcaacattgttttgcagtcatcaccatcagctatctccaaaacgttttcatcttcccaaaacttaaattgtgcgcatgaaacagtacctctcctttcccccttcctccagcccctcccagccaccactctactttccctctgtctgaattcacctctctaggtacctcatgtaagtggaatcgtgcagtatttgttcttttgtgactgtcttatttcacttcgcatggtgtccgtaggggtcctgcacgttgtggcatgcgtcagaattgcttccttttttagtgctgaataacactccattgcgggaatatgccacattttgttgatctgttcttctgctgctggacacgtgggttggttccgccatttggattgtggataatgctgctgtgaacaggggtgtacagatgtctccctgagtcccttctttcagttcttttgggatatacccagaagtggaattactggaccatatggtagctctttttaaaattttttgaagtgccatactattttccacagcagctgcacccatttacatttctattatgccaacagtgtacaagggctccaatttctccacatcctcaccagcacttgtgttttcattttttttgtttttcttttctttcttcttccttttttaaatggtactatcccaacaagcgtgatagcaggaatttgcttttaattacagctacttctggcctcacgagacgtctttcagaggaatgtagtgtgatctcaccttggaaacgagagctgcctcaaggcagtggtgcatgcggtgctgacaggtgccaagggtcactgccttccccatggacatctgggctgtgctgcagtgcccctgtgggtgcagcagggcccctagggtgcctccgtgcagcttgggagccatggaactagacagtgtgcttcagacgagtagataagcacagaaacagagccgtaaggactggggggaacgtccagtccatagttctgtgtggaaccacgatccacggaggcagctgaggggcaagtgtagtgtacgtggctgtgcgctccatctccgtgcttacagccctacaaagtgggaagagaatggaagaaacaggagagaaaaagtcccgtgtggtttcccggaatcctgtgggtagtgagagtctcagcattgttattcctagcatgttttgtgtgtaacgtgagatgaagcaaatgattactgatgtgatcttttaactctgaggaccttgaccaggattttcagtggcgaggagaaaggagatacggaggaaaggtgctgcgggttaagaaagcctcgggaggctgggcgtggtggctcacgcctgtaatcccagcactttgggaggccgaggcaggtggatcatgaggtcaggagatcgagaccatcctggctaacacagtgaaaccccgtctctactaaaaatacaaaaaaaaaaaaaaaaaaaaaaaaaaaaaaatagcggggcgtggtggcaggcacctgtagtcccagctactccgaaggctgagacaggagaatggagaatggcgtgaacccgggtgaacccgggaggtggagcttgcagtgagccgagatcacgccactgcactccagcctgggtgacagagcgagactctgtatcaaaaaaaaagaaaaaaaaaaaagaaaagaaaaagaaaaacaaagcctctggaatccggaactacaaatccataagtagccctagagcgttccctggagaggcctggaatcagtggccaaaccaatcacacggagcacccccagtcccgggtcatgtcttgaaattcagttttctgctgaaagaagctgagactacttggacaaatggttgataccgggttgggggcgggaaatgtacaagttgaacctaaatgctttgtcatagcagataataaaggagccaccctggactgtgaggatgtgattctgctgagagagagcattaaaagaggaaaaaaactattaaagtcaaagtccacgaggatagtgttaaaaggactcgtgagctcacctgatgaggccagagatggacaatttgaacatcagtaagagtaaaaatcacagtaggttgaaatgtatgcagtatgtttaagtccatgagtttttttaacaatactcaggaaataaacctaatccgtcacctttggagaatgctagggaaccaattatatatttttggtaaataagggaaagctctgaaatatatatcctgcttttcttatgcaggccgcactactgggtgagcaggtggcaggttgggaggttccatgtatagaggatggaacctctgtgtctgaagcgtctcagcacatctgaattcacaagctgggcgctggtggccctggggcctgctgacatctcaggaagggaggaagagccacactgcccgggagctggtctgcccctattctaacagggatctcattcgacttccagatccaaccactgatttgcaggaacggaaaggacagaggacgatgtttggctgtgcttcaggcacctggccatcaaaagccaaaccatgggaaatgctgtgtgaccaacgactcttcagttaataacttgggaggcaaaaaaaaaaaaaaaaaaaaaaagaggtggaagcacaaccaacggttaaaggggacataaaaggcacacatagtgtgtgtgtagggacatgtgctacatggagcagggtggggctatgattaccctacaaccaggatgtggtcaggggcacacagggaggctgggtcccgagggctggagtggccggtagggcccctcttcttccctgcctgaggattgtaaaggttgtttcatagccgttttgtttgtttatttatttatttatttatttagagatggagtctcgctctttcgcccaggctggagcgcagtggcgcgatctcagctcaccgcaagctccgcctcccgggttcacaccattctcctgcctcagcctcccgagtagctgggactacaggtgcccgccaccacgcctggctaattttgttttgtatttttagtagagacacggtttgaccgtgttagccaggatggtctcgatctcctgatctcgtgatccgcccgcctcagcctcctaaagtgctgggattacaggcgtgagccactgcgcctggcctcatagccatttattaagctaaatatttacactatgttttctaaaaaagtaaaattattttaacaacataaaagtcaaaggaagaagttcctggaagtggtcttgaaggtgcaagtgggcaattgtgaacagtctgctggtgcaggatgtggcgcttcgtcgtgggagtgctgtctccctccactgtgggccgcgctccttcctgcagcactcgcagctcactgctgccatttcccgtgtaatcctgtcttctgtcttgactcagacccactcgtatctttgttgtctggggtctgcgctttactaggggaccttggagttctgttgttggctgtgacttcattccatgttctttcccataaggaactgtgttgggaatagtttgatgattccatggtcatgccttttggccttttctgtgaggggcgaatggggagcacatggaacttattgctgctgtcttcagtatttcttgggggaggaactcggtgtggttttttccagcctgagcccaccctgaggtcggttgttggacccacctgcctgatgcagactgccagggtcttcctgccagcgcgggatcccccactttccatttcctcttgcaaccatcagacccagggacacatgtgtggctccttctccagtaagcgacctgggaggtatccttaccccaggacccgagtgagcgtctgttggagactcccaggtgtgcaggccagaaggacatgcccagttgtgtggctgcctcttccctgcagggagagagagaaggctggcgtggggcttctccccgggctgggcctgcgttgtccccgaggcccgtggccgctggagcagcccctgagcgactctgctccttcctgggcctcggtttcctcgttctcagggggggcttctgccagactgtctgggagatgttttcagccctctaatttgtgcatgctgtgactcacccaaaattacagagcaaagctaatggaatcaggaatttataaatcccccttccttcctcacgcggttccttgagtttttgaaaactaccattcagaatgagacagtggccttctacctgaggccacagggttgtctgtggcctaactgatttctggccagtcaggctgggtgagcctcaacagcgtgaacatactaaaggcttcttccttgccctgggacaccggttctggccaggctacagggctcacagctcagacctgcctctgcctgggagtgacacggtcccctctgctcacgtgccatggatcagagctgccatgtggcccagcttagggagaccaagaagcatgggagactccccggctatttgacgagcaggacctgtccatgccatctcccatctgtgccctgcatctgcgacttccaaagagcattggcctgcactgtcctatgaaatgctaccacaagccctttctggcaagtgcagttaatcctgttcggtgggttaggaaaccaaggctctgagggaggctttcagtgccacagctgggaggtgagagttgtgagttgcagatgtctcagccatcccgagcgtgaccattctgagtggcgggaagcttttcactcagcactgagtacatgatgcctacagtgttctgggcctcctccatcaggaatcatgggcccttctccccaggacgctcatcgatggccccggctcctccagccctggctcctccagccctggctcctccagccctggcccctccttgggctgtggctgcaccctgggctccacccattccagacccaaaggcccatgggccaaccagacaccgcccctacatggtgtgcccacaggctcttatggatcccagagggccccctttgtcctgcttggggaggctggggtggccgctacacagtgccctgccgtggcccccatgctccccaactccctactgtgtctgctggacgtttgaacagcctcctgccctaaaccttgcatcctgccacctctggcccactctccaccctggcctactcttcaccctggcccactctccactctgcagccaagtgatcttttccagcagcacatgtgactgagtattgctgatggctgcgactgctttcaggatcaaattgtgtctcttccgaaagagacatcagataagagacattggaaaagaacatgaattgcggtcacccagagctctttcgcggtttgggattaagccatgcagaaaggtgtgcaggagcctagatcacctgccaacctgcctcttgccatcctctattttgtacgctcagtcaccccagaaaattgctccggcccttggatttacctccgtgtcactgtccatccggtaccctctgcctgggatgcctcctgggtctccatcacccgcctcactcgtttttcctctgcacatggcatctacttccgcccttccgcaggacaccttcccaggctgggtctggaccaccctgcggactcgctcctcgcaatactggccacatgccctcaagcccatctgtttcttagagtcgatgtcccctaaggtgtgagttcctggtgagcaggagaacctgtgccttttataacctggtgtgctgctcggcgtgccgaaggaaccaaggcgatgttgagaaatgaatggaacagctgtactgtgcagagatacgtgcagagaggggcaggaggaagcctccacttcagacttcagtgtgaaaaagagacactggaaaagaacatgaaatgtggttgcccgatgctcctttgtggtttgggatgaagccctgcagaaaggtccgggcagcactgcagccccgccatgctgcttgccccacgtgggttctggagtctggtggcacctggaagagcaggtggagtggaagctgctagaaggtgggaacctgagggtcctgggctggcagaggccttgcccccgctttgcctagggaggcagtgagcttcctccttcatttgaactttgccctgaagagctgggccttccttgttcatggggagcctgatgcttcttcccagcacaccacagccacacaggaggtgcagcagagcatgcggagatccacctggcaactcacagccagccgcggcgtcactgtcaggactctgtgaaaaacaaggtttctgtttggcgcggggacgaccagagggaaggagactggtagagcctaagtattcagccgaccattaaaaagtgaaagtcagaagcaatgtaagtcaaaactcaggacatctcagggtgaccttggccactcacagttgttcgtgtttgaaatcacattgattctcgcagctgtccaaggcgcaggaaataaccactctgggtgatgtcgttgggatggttttgtcagcactcaggatttgggggtttgttatgaaaatttcacgttacaaaaaagggagaagtgcagttttgtgtgtttagggttattggtggctagacatctgaaaatcaggatccccgctcattgattttttttttttttttgagatggagtcttgctctgttgcccaggctagagtgcagtggccaatcttggttcactgcaacctcggcctcccaagttcaagcgattctcctgcctcagcctcctgagtaactgggattacaggcgcctgccccccgcctggctaatttttgtatttttagtagagacagggttttaacatgttagccaggctggtaactcctgacctcaggtgatcagcctacctcggcctcccaaagtgctgggattacaggcggtgccgctccttacattttgttgctgttcccaggaagattgatggagggaaaacacactctccacagaggagatcctgtgtttacagccgtcttagatagagtcgtgatgaggaggaggactctgggccgacagtgtatgagggttccgcctcataaggctgtttggtgtttgtgcccacactgggtgtgacgggttgaagcagtggataacaagcctattactgttatgcaaatgtgggcggcccagttgcattcttcatgcatgtgtctctccctaatgagtttcaaaatcttaatttagatcttgattttgttgcagataggattccaatttaaagagcgtttgtcattcagagactgtggtagacaggaaaatggtcttcagagatatccacaccctagctgtggcgcctgtaaatctgttactttatgtgacagaaaggactttgcagatctgattaagttatggatcttgagatggagagattattctggattattcaggtgggcccttataatcatggtgacccttataagaaggaagctggaggagttaattgtcagaggagaaggtgctgtgacgatggaagtggagattgaagtgatgcactttgaagatggaggaagcggctgcaagccaaggaatgcaggtggcttctagaagccagaaaaggcaaggaaacagattcttgcctagagcctccgtaaagaaccaggccagtcgacaccatgaccttagcccaaggagacctgcgtgggattcctttctttttattttctttcttttcttttcttttttttgagacaggatcttgctctgtcatccaggctggagtgcagtggcgccatctcagctcactgcaacctccacctcttaggttcaagccattttcgtgcctcaaccacccatgtagctgggatacaggcacatgccaccatgtctggctaatttttgcatttttttgtaaagataaggtcttgctatattgcctaggctgttcttgaactcctgggctcaagggatccacctgcctcagcctcgccaagtgctgggattataggcgtgagccactgcactcagccctctgtgggatttctgaactatagaactgtaagagagcaagttggtgttgtctgaagtcactagatttatggtgacttgtcacagcagccataggaagctaacacagagactcagggaccaagcctttccattgcagcaagattgatcagttgttctctcccatcacggggctctcattttgctcaagtcctatgtcatcgtccctcttttcctggagagcaggagctgacttcagacgccagatcttcttttcctgccacagcgcacttgcagctcttgggaggtgaaggttctgcctgctgctcttctggaatgataaacgctgggcccttagtggaaatgtcaggtgaaatggaaggcagctccttgggtgcagtgacaggacctgcagtgggcctgttggagctggcactgagggctgctccccatccctctgtgggtgtattggctgcatgctgactggccgtcctcgtgggcgtggcctggtgtgtgtgcaggtggacagaggctggagtatccttgagaggctgtgcgttctctcggcttcttttggagccagagccatcagggagccatcacctgtcctggcctgacctgtcctgtcatgagtgctgtgttccttgagctgcctctcaggctaggggatgaggtggctgtgctcaggcctggcttctgcaggcttcttcctatctttggagcggctccaccactggaatctgtgacatgagaggcccgtagcccaggcccatcatctagaatggagaggcagccccacagcctcctgggaaccagagctccttgcctgggtcatcacagaactaagccttaaaatcaggaggcctcagcaaagcgcctctagagactcaaaccaccttgtaaatctcactgggagtgaacgattgactttttactcagtaccaggactacatactacctcatttatgggtttttcctctaaattgctaatgtttgaagtggaaattttcaaaactgactaatgtctctgcttcaagatttgctgtcaggcaacttatttataaataaagcagcttttcaaggagcactaacaaacaatccctcgtgttaggagactcagagccaagtcgtggctctaggttggccttgcagggtgttagggagccagttctccaccccagggccatggacttctgggtccttgcaccatccagagaggtgatgatgtggttattcccatgtatagagtctactgttttcagggggcatttgcatctgtggtttcattagatgttcagagcatccccacaggggttagttcatgtagagaaggaatcagaggctcacagaggttcagggtttgctgggtcaccagctcctaagaggggccctttgggctgaggccacggcgctttctttcttgcaagacagaaattttccttttcctttctttgccataatggccacctccttccaccccatatccttcttccctttggccactggtgagttctgattatttttggaaaaaaaaaaaaattaaaactctgggagcttgagactgaggtaaagtcccctttcgtagagatttttggactgacatgttagctctctgccctgtgtaacttcagagtttggtaggtgatggggacacgcctgttggagagtcctggtgtgtccagttttgtccccgcagcttcactggctgtcagagccacagcctttgcttacggctacgccctggaatatttaacagcaatttcttttcgctttcttctgtcgtgttctgtctgtgtcagtgttttgtggtcttactgtacctgttgttttattataggcagatactgtaaacgctgatacagtctgtgccctgcggttgtggtttttagggccttgcggcggcatctttgctagtgctcactgcaaataggggcaggaagcagttgtttgggaatgagccacatggtggaatatcttgaatgtcccaggccaggcacagagcagctgctcagtaaatgttgctgagtgagaggctggggggttggtgaggataggcaggggtgggcgtccaaggctgcagagttgtaaagcggggggtggggcagccagcaagtccagctcgaggaaacaccacggggttcaggggctctgtgtaagaaatggcagaggtttggcttcgcttttagttgttttgtttcttgttcaagtgaggagaacacaccgagaagggaggagagcaaggctggctgagcgtcatggcagggtggtaaaggaatcaatcacccggacaggttgtccgttcatgtgccgttgtttgcattgctgtgatacagactgctgtgccactgaaaccttccgaaaagcaagccacccagagagtgacttgggcaggtgtgtattcatgtgtgcatcagggagaggaatacttgcaaggagcagagcttccagaagaccaagattcagtggaggcagcaagtcagggccgggcagaagcccctggggtatctgcggaagagcactttccagggtgcatggatggatgcgttaaccagccagttcctacgcatcacggaggagaggtgcctgccctcctgggagccgtgcctattccattgcttctgttgtttttttgagacagggtctcactctgtcacccaggctggagtgcagtggcacgatttcagctcactgcagcctctgcctcccaggctcaagcgatcctcccacctcagcctcccaattagatgggacttcaggtgagcaccaccatgcctggctaatttttaaatgttttgtagaaacggggtctcactgtattgcccagactgttctcgaactcctgggctcaagtgatcctcatgcctccacctcccaaagtgctgggatttcaggcgtgagttaccacacccggcctcttgttgttgttagtaaacttttaattctagaacagctttaaagttataaaaaagttgcaaagactgcagagaattcccatgcttgcttcctccagtcttctctctcgttaacatcttacatcacacggtgcatttggcataactgaggaaccaacgtgggtccattgctatgaactaaactctgcagtttattccaatttccttagtttttgcttaatgttttttttctgtcccaggagcctgtccaggccactacgttacctatagtccttgcgtctccttagcctcctctggtctgtgacagtttttcagctttccttgtttttaatgaccttgatagttttcaagagtacaggtctttgtgaatatccttcgatttgggtttatctgctgttcttctcatggttagactggagttatgggtttgggggaggaaaaccacagaagcgaagcaccattttcaacatacatcaatgttgcatgatatcaatatgactcataactatcgatgttgaccccgatcagctggctgaggtagcatgtgccagttgctcactgtaagattaccccaccttcagcggggtgcggtggctcatgcctgtaatcccagcactttgggaggccgagtgggtggatcatgaggtcaggagatcgagaccatcttggctaacatggtgaaaccccgtctctattaaaaatacaaaaaattagccaggcgtggtggtgggcacctgtagtcccagctacttgggagactgaggcaggagaatggcgtgaacccaggaggcagagcttgcagtgagctgagatcacgccactgcactccaccctaggcgacagagtgagattctgtctcaaaaaaaaaaaaagaaagcaaaaaaagattaccccaccttctttccatagtcctccctggaaggaggtcgatgtgcagagcccatgcttaaggaatgtggagttacactccactccttcatggggggtggggatatctgtataaattatttggaatatttctgtatgggggacttatctattctcccccatttatttattcaaacatttacatcaatatggatttgtggatatataatttataccttgctttataatccagtgctgtgttatttattttattgctcaaactgtcccagctttgactatatgaagctctttcaggtggcatcccatgtcccttagagagatccctacctttttgtttttttgagtacagtcagttggccatatccgtgagttctgcatctgtggattcaaccaaccttagatgggaaatatctgggagaaaaatagatggttgcatctctactgaacagactttttgtcttgtcatcattccttaaacaatacagtataacaacgatttatatagcatttacattgtactaggtattataaataatctagaaaggatttaaaatatattgaagaatgtgcataggttatatgcagattctacaccattttatagaagggacttgagcattgaggattatggtatctacaggggggcctagataaccaatcccttacagatacccaaagaaaactgtacctctttctggcacaagatactcaggctcatcttgaatttttcctacccagtcctggactcagctatttctgcaaggatccctgccttattttattgaagaatggtatctagaaaccaaggtctggagacagggttcttcttgtcaccgaggtacattgcttccaggccctctcagcagacagagctaggaaatatgcatgtatgctaatctgtgtatacatatgtatctcccatagtttttttttatttttttattttttgagacaaagccttgctctgttgccaggctggagtgcagtggcacgatctccactcactgcaacctccgcctcccaaattcaagcaactttcccgcctcagcctccctagtagctgggactacaggcgtgtgccaccacacccagctaatttttgtacttttagtagacagagtttcaccatgttggccaggatggtcttgatctcttgacctcatgatccatccgccttggcctcccaaagtgctgggattacaggcgtgagcccactgcactcagccttttttttttttttttttttttttttaagacagagtctccctctgttgctcaagctggagtgaatggcacaatcttgtctcactgtaatctccacctcatgggttcaagggattctcttgcctcagcctcctgagtagctgggattataggcatgcaccaccacgcctggctaatttttgtgtcccatagcttttttttgaatgcacgaccccatctggcggcgaagccctggacctagccttctgatcactcatgggaaccatgaccacgtgtcacatagtagaaaggaaaacttggacaacttactgtgtagacaggagcagcaacaacaaaaaagacttggaaggcttaaagaatattttccaagtatacacaaatacagagaataataagaggaatgactttgagagcctgaggcaggaggattgcttgagcccaggagttcaagaacagtctgggtagcatagagtgaccttgtctctacaaaaaaattaaaaaaaaaagccaggtgtggtgacgcgcaccagtggtcccacctccgtgggaggcagaggcaagaggatcacttgagcctgggaagttgaggctgcagtgagccatgattataccactgcattccatcctggctaacagaccaagactctgtttaagaaaaaaggagtatctggggtacctgctatccagtttaagacatgtacaaatatgattcagccttccatgagcatgcctccccagccacccctgtgaaacccagtaaattgaatttactgtttgttttttggaggcatgttttatttttacactgcatgtatgcctaaatgatatatcccattgttatgatattttcaaactttgtagaaatgataccttactgtgttcctacaacttgaattttcattaactgagacattttacatgtatttatcttcttagcaatcctgagaaaagcaagagtcactatctccattgtatagatagagaaactgataatgtagagcaatgatgtgatttttgctaatttcaagcagctaatggagatcgactcacatttgtaccttcagagccctagtccatgctctttgtatgacataaatgtcaagattcatcaggaaaaggaagaacaggcgggtcttgttggttactctgtgaccctgttgcttccctgggacctggaagtcctggtgtctcccttagcctggaatcccagtctccatctgggttttgcaggctccaggagttttgatgaaatgaggacccatatggctggttgagactcccaccccctcatcactccctaccagcgtttgtgcagaatcctcctctcctcccgagttggaaataatgtatagttggctcaaaagtcagcccctccttattttagcaccagatgctgcctctcagcttcacgctgccctccagcagcattgcctgtggtccatgggatcttggccttcacactcagcattgaaacagctgccttccgctcccatcataggaaagagaacagaagtctcttgctcccactccccccgccccaccccctgctgctggcctatttctgtgctttgttttgctgtagaacttctggaaagagttgtctgcagtggctttctccatttcctcccttcccgttctctcttatacccgctccagtcggacttttgccccttccacagacacctctcctgacacttttgaccccatcacttagagatcaagatctgtaagactccaagtctccagatccagtggtcagctctcggtcccttcccatgtgactgaccagcagtgtttgccacagtcgtcccctctaggaaacaccttcttcccttggcttgtggggcactctgtgcttgggattttcttcctgcttcactggactttgctcagtccccttactgacccgtgagtgtcagagtgtccctgcggtcagtccatgcccctcttctccgctcggtccacactcccaccatggttgacctcattccgacttgtggcacaaggagctcacatttatcttttagctctgatttctcttctgacctccagactgtacaccctgttgctcacccagcgctttcccttagagttctaattgacgtccccacacaacaggcaccaagctgtccctggccatctcaaccccaatctccacatctcagtaaatggcagctccatgcttccggacacctagaccatagacttggagccaaccttgactcctgtctctcttaaaccccacatggaatctgttccgtaagctgcccatggtcacaccggcaccgctgccgtgcgatgagagcctgtcatctccttgctagattgctgtgccagtttcctgatggttcctgtttccacactgactgcataccttcccacccaagtctgtgtctgctcagcagctggtttattgcatacaaacttaaatgagaatgctcctccgaccagagctctccgttccctggccatcccattaagagtaaatgctggaagcccctcctcaactgactttatttcttaaaactctatcctgcaaaatcctgcctggctaataactttatcaccttcttcgtgttggttccaacgttcccttctgcaggtggcttctgcggactttggtactggcccacatccctgagctggtaaccccccaccatgcacaggcacccccacattaattctgtagcttatttgtttattgttgtctgtgccactccagacaggaagcctgtgggggttgggggcttggtctgccttcttcagccctgggctcacagtcctgacatcttcttgaagacggcgctcacggtcaggctgcagcaaattcacagttgacatctaggagtgagggcctcctgccatgctgcactctggcctctcacctgcctcctgctagtcctgggcacacctggaggacaatcagggaatttctttccccatctgctttggcatcctccaaacctgggaacctttctaacacctgactgcttggtgaccatgtgtgtgctctgtggatttctgtccaggagggtccctcactctggccctcagggccatgtgcatgtggacaccgactggtagggttggtttcctatgcagagagcagggccagaggcatagccggcccacccccagccccattgctcacggttcacccagtcccctggcctttccgacgctgtgcgcatctgtatttgttgcagtgaacagagcctagaattataggactttgtcagacagtttgattttcaaccccgtaaaaaatacattttacttaaccacctaggatacctctacattatagacctcaagcagaagtttcaggagacagtttcttactctcattagaggtgatgcgttttgtgtggtcttcggtttcattgccccataaactcacttggcgatctgcctgtgggtccccagcagtctgtaagccacagctttctcaaccgtacttcctgttctggaggagaaacctgagctgcaaagagctaagggtcttgctaaggtcataccagtgaattcaccaaacagccagtactggaaccctgtcctctgattcccatcctgtggcttttttaggcttgtgtaatcaattttaatgattgtaccattgtagcttatttaaattaccccaggaggaacatcagctctgttcaagaaatgttattgtagttgctcacctgctttgttcagggaaatgcatcttttgtgggatttcttctgagtaattaagagggtctaagaagccagttttatagtcatttatttaactgtagagaacaatgaagttaaacacaaaagctggttccatctgcaggaacatatgagtgatttgcattagaaagggtgttcatcaaagctcctcccaggtgcctagggaggcatggggggccttggtgggttccctgagggtcgggccaaggccttgggccagggagcacagttccattgcactgggtgtgttggggcagaaccttgtgcttggaggtaggtgttgcttctggccctcggttgcttgctcctgcaggcagggccgtggacccgtagctcagcaaccatggaggagctgtgagaaatgcacagtctcaggccccaccctggctctgctgacttggaacctgcatgttaacgagactgggggtttgtatgcacatcacatccggtccagctctggcctgaggactccggtctgtggtttctagtttttatcatccagctggtcatcctcagcagtagagaatgtggttggttaccatgtgcagggcagcctgctatgtgctgtggtaacagaagggtggggcagagccctcctagccctcccagccctctggggcttgctgtctctagggcaggcaggggctggcatatgcagttgtacaccatggtgttttacaaagcacgagtgccatggaccccatgggtgggctggattgagatgcaaggagggaaaacagatggggtggggtcccaagcaggaggaactgcatgaggaaaggcgtggaggctggacagatgcagaggcagtcagggaatagccagtgtcagaatggagcaggcgacagccgggttttggaggctttcagtcccacgtttagatatttggactttatccagtgggtcatggaagctactataaactttttaaaattaaatactattttatttaaaaaattgtgtaaaatacacataacataggattcaccttctggaaccatgtttaagtgtagagctcagtcgcattaagtacatttacacggttgtgcaaccatcaccccatccacctccagagctctcctcaccctgcaaaactgaaactctgtccccattaaacacttaactcccattcctcctcccctcaccccctggcacccaccattgtactttctgtctatgattttgacgacttcaggtgcctcgtatgagagcaattgtataggatttatattttgtgactggcatatttcactctcaacgtcctcacggtgcacacacgtcgtagtgtagcacgtgtcacagtctccttgtctgttaaggtcgaggaatacttccttgtatgaatagaccacattttgttgatcgttcatctggtgaaggatgcttgggttgcttttacctcttggctgttgtgaatcatgctgctgtgaacatgggggtacaatctctttgagctcttgttttctttttctttttttttctttttcttttgagatggagtctcgttctgtcacccaggctggagtgcagtggtgcaatctcagctcactgcaagctccgcctcccgggttcacgccattctcctgcctcagcctcccgagtagctgggactacaggcgcccgccaccgtgcctggctaatttttttaagtatttttagtagagacggggtttcactgtgttagccacgatggtctcaatctcctgacctcgtgatccgcccgcctcggcctcccaaagtgctgggattgattacaggcgtgagctactgcgcccggcctgagctcttgttttcacttccttcgggcatacccccagaagtggagtcattcctagatcatatggtgattctatttttaatgttttaaggatagcattttccaaaggggctgcacaccattttacattcctacccaccgtgtacaagggttccagttttctccacatcctcaccaacacttgttattttctggtttttcaatcgtggccaccctgatgggagtggggtagcagctctctgtggtttggatggcgttttcctgatgcacgatggtgtggagcacctctcctgtgtgggagcactgtggcctggtgagcaggggctctgtggtggggaggcgcgtgccgagggctgtaggagagggcgacgggtggtgctgtgcatcaggttcggggtgatgggaacgctgtctcttgcacctgcacatcaggcctcccccatgctactttggtggcttctgtgggagcacaatatgtccagggtgccatccccaaggcagaagggagcaccatctggtttgatgtgtggcctgtacttcaccaagcccaccacatttggcctatgactgtgtcctgctgcgactgggttgaagtcagaggagccgagacaggcgggggagcatttggaggacgtgtcccttgctgtggtgtctttgcagaagtggccagcacttgcactgcccagtagtattttcgatgctcctgggaacatgagaggattgcactctctgctttctcaaagttagataagaccatgtgccttgcttcagccaatgacatgtaagcagaagtgacttgtgggtagaagctggaagggactttctatgctgtcctttctccagtcacatcggtcctagaagcacatgcctaggaggaggggccataatagcaacgtggctgttatttgctttggactcacagtggactttgagtgagcaagacagaaaccattactgggcccaggccctgtggcgtgggagctgtttgttgtcacagcacagcctagcctgtcctcactgatccaggaggaacctgaaaagtattttaagtgcacagataggtgaagatgaaagtgtagcgttttgggataattctgcatgcttcttagtatctccagcagtttcgagatttggcgaaggggctgaacttttctgtaggtaaatctcttgctgaagagttcattatcagctggtaatggcttcattttgtcagcggcacagagctctggcttgtgcgtgtctgaggcctgtccccactggggcagggaggtaatgagaactcatgaaccctgcatctctgcctggctttaacagcctctgtgttttccagtgcttatcaaatccagagctgtttacatttcaggagacaacttcagactctgtggacctcattatacttccaaagcaggagggtcgttgtttttaagcattattcccaacttttttttttttgactgcagaaatgcctttttaatatcagaaaatttccaagttttccttacttggctatagtcttgtttttagtactgctttggtggttcagtaactattcattaaacaaatctcttcattttaagtttatttcttctatagggctcttctcttctcttctgttctcttctcttctttttgatacagaatctccctctgtcgccaggctggagtgcagtggtgcgaccttggttcactgcaacctccacctcctgggttaaagctattctcctgcctcagtctcccgagtagctgggactgcaggtgcatgccgccatgcccagctaatttttgtatttttagtggagacggggtttcaccatgttggccaggacggtcttgatctcttgacctcatgatccacctgcctcggcctcccaaagtgctgggattacaggcatgagcctccgcattcaaatatatgtaaaaacggagagaattgtgatccctgaaaattcatgtgttgaaatcttcacccccaggacctcagaatgtgactgtatttggagagagggtctttgaagaggtaactgagttaaaatgatatcatcaaggtagcttaatccaatctgactgatgttcttgtaagaagagattcagacacagacaggcacagacggatggccgtgtacatacatggcggaagacagccgtatgtgagccaaggagcgaggcctcctgagaaaccagccctgctgacaccataatctcgacttccagtcgccagaactggaagaaaatacatttctgttggttaagtcccctagcctgtggtactttgtgatagcattcctagaaaactaatacagtgcctgtgtgctattgttcagtgtcagcagttccagtttttaagcaatcttcatggactgctcccgaagttcagggagcatggggcctatagcagagaactaggcagcacctgcccttgtgaaactgacactctacggaaactggaaaaattcatgaggacaagcttcagttaacaacactttgaggctgggtgtgggagcttgagcctgtaatcccagcacttcgggaggccgaggcaggtggatcacttgaacccaggaatttgagagcagcctgggcaacatggtgaaacgccatctctactaaaaatacaaacaattagctgggcctggtggcagttgcctgtggtcccagctacttgggaggctgaggtgggaggattgcttgagcccaggaggcggaggttacagtgagctgagattgcaccactgcacttcagtcagcccaggtgacagagtgagaccttgtttcaaaaaaaaaaaaaaaaaaaagacactttgagactgggcgaagtggctcgtgcctgtaatcccagcagttcaggaagcagaggcaggagtactgcttgaggccaggagttcaaaaccagcctgagcaacacagcaagacccctgtctccacaaaaaatatattaaaattagctgggtgtggtggtggatgcctgtagtcccagctacttagaggctgaggcaggaggattgcctgagcctgagaggttgaggctgcagtaagctatgatcatgccactgtattccagtctgggtgataaagcaagaccttgtctcaaaaaaaaaaaaaagagcactttgaattctcataatcataatcatatgacatctgtctaccttagaaaccctcgctggtgggtggtcacacataatgctggtggtctgcggggggcagatggactctcacaccctcctaggttcccctttaggaactgaggcttcaggtatgggaagggtttgtggaataaatggatgaaaatggaatgagaagctttgcccacgtcagagccaacctatcatgtggaccaggattcagaccacccctgggagaggaaccaggatgcacccatcattctttttttttttttttttgagacggagtgtcacactgtcacccaggctggagtgcagtggtgtgatctcggctcgccgcaacctccgcctcccaggttcaaatgattctcctgcctcagcctcccgagtagctgggattacaggcgtgcaccaccatgcctggctaattttgtatttttagtagagacagggtttctccatgttggtcaggctggtctcgaactcccgacctcaggtgattcacctgcctcagcctcccagagtgctgggattacaggcgtgagccaccgcacctagccgacacccatcattcttacacagtgaagacccagggagatgatgagtcacaccgggaagtgattcatttgcttactgttaagttcatccaggattcctttaaataccaaatccccatatacgcttaaaaatacctagttcactcagaaacagtgtgctgactgacggaagccagacatgaaagactatgtggtgcaattccatgtataggacgtttctagaaagggcctaatgacagagatggaaagcagatgagggcctgcttgggtctggggcgtcagtggggattggctgcaggcagccatgaggagccttcagggtgatgagggttctaaaagtgcgtcgtgtgcctgagccactgcgacattcactagaagtcctccgtgctgacggagggtgaactgtgtggggcccaagttctatctcaggaaagccagggaagccactcagttcagctttgtgaaaatcaagggagtcttcttggaggaagtggactctgagctggatgtgaatgacggagtgtctttggtaaggagagacagctgcaggggactcctggtggaggaacaggatcccgggggagcggccgggcgggtgactgaggcgccaatggaaggagaagcctgtcacaggtgagggcattgaagggaactgcagggacacccagcgcttctcaactctgactgcagatttccagctgccatttctaaaggacaggtgcctgggctccactcctggaggtttggatttaatcagtctcgggtatagatcccggacgttagtatttttaagcatatttttaaatgaagtgatactctaattctatcattttctttttacttctcagcttgttgcttctctaaagagatacctccctttatccattttgtggtcacccagtgggacagttgagagagaaaaggccgggtggcatgtgattcttctacttcatttaccagttttgaagatgatgaatttgtttcccatgaccttccaaaggtggttttttaaaatttattttaatctatcgtcgtgaactcctggggcgtgaacgtgtgtcataggtttcaaaccactgcaatcattatcctcattgaggttcattgtggctggtggtagtgtcttcatattggcctctgagaccttctgacctgattctagttatctttgataatttccttgtctttaaaaaattataattgtatatattttttaataataaagatgggtttcggctgggcgcggtggctcacgcctgtaatcccagcactttgggatgcagaggtgggcagttcacgaggtcaggagattgagaccatcctggccaacatggtgaaaccccatctctactaaaaatacaaaattaactgggcatggtggcgggcgcctgtagtcccagctactcaggaggctgaggcaggggaatcgcttgaacccaggaggcggaggttacagtgagcagagatcgcgccactgcactccagcctggcgacagtgagactccgtctcaaaaaataataataatagtaataataataataaagacagattttgccatgttgcccaggcttgtctcgaactcctgggctcaagccatctgcccacctctgcctcccaaaatgctgggattacagtgtgagccaccatggcccagcctaacttccttgccttttaagagtaaagcagttttatttcccattgctcttccactagctttaagtatgtgttaatttattattttaggttgtcctagaggttatgatctgcagactcattagatgctagtgatgctggtcttctttaaattggtactttaaccgcttcctggacaaggcagggactttgcatacagatatatcagtatggtgtggaagacagctacactcaccattataccacctgcacagatatcagtatgttttgaaagttgcctggagaccttggtggcaatccagggctgaaaactctgggtggggcactaggtgggtggcaggtgcactggggactgaatgggatgctgtggcagagaggaccagacctaaagcctttagtgaagaaggcctggtgtgaattttttagctggttatcaggttcatattttaaagaatatttttctaattacgtttgtttgtttggtctggcctgatgtgggacgtggtattttcagtgtataggtcttcctagagttgggaaggagggatgcccttctgttggagatgtttctgttaactcaggtgctttaggaatggaaaggaaagtcatgcagctcaggcccggcaggggcattgttgaagatcctcagccagtgaggcgccttccctgtgcccagcacattgctgaggaccttgcctgaaagatgtcctttcatcctccccacccacctgaaagatgagaagtggaggactgatgagaaccttccagatgggttctccaagccacacagctaacaggtgccagagtcggaatttgaactcagctgtgacttacttctgttaccagcagaagtgggtgagaaagccggccacagtccactaaacacgggctatgaccaaggtctctttgacaacataatccaacaaataggcttgttttagaatataaatctcaaggaatttggggggagttgatatactcttgttttttactttttattttgaaatatttttagattcacaggaggttgcaaagaaatattcaagaagatcctgaacactcttcacttagccccgcttcaatgttaacattatgcataacgatagtacaatagtcaaaccaggaaactgacagtgatgtagtcaacagaaactagtcagactccagtagttataatgtatgtatgtgtgtgtgtatgtgtgtgattctgtccaattgcatgtgcaacttcatgtaaccaccaccacaatcaagatatttaattgtatcatcagcaaaggactgcctcatgctaccccattgtagccacatgcacagtccctcttccatcattcctaacctatggcaaccactggaggacatttggagtttccagtttggggctgttatgaacccagatctgctatatgaacattcacttacaagtttctatgtgaaaacaagtttttattcctctatgatcaattatctacaattgctggattgcatggtaaattcatttttacttttaaaggagttgccaaactattttccagagtggctgtaccattttatattcccattagcaatgtatggatgattcagtttctccacatccttgccagcatttggtgttatcactgttttttattttagctattctcataggtgtgtagtgatatctagttgtggtttagattgcatttttctgatgcctaataatgttggggatcttttcatatgattatttgccatctgtgtatcttcacgggtgaaatatctgttcatcacttttgctcattttttttttttttttgagacgaagtcttgctcttgtcttccaggctgtagtgcagtggcacgaacttggctcactgcaacctccgcctcctagattcaagtgattctcctgcctcagcctcccgagtagctgggattacaggcgcctgccaccacgcctggctaatttttgtatttttagtagagatggggtttcaccatgttggccaggctggtcttgaactcctgacctcaggtgatcagcccacctcggcctccgaaagtgctgggattacaggcatgagccaccgcacctggcccacttttgctcattttctaattagattttttttttaattgttgagttttaagggctgtttatatattctagatacaagtcctttgttaggtacgtgatttgcaaataatttctcccagagtataatttttttttctgttatcttaacttgacccttgacagaatgaaagtttttaattttgaggaggtcaaagttttatcaaattttttccttttatggatattgtgtttggtgtatgtctaggaactctttgcctaatcattaaggtcccaaagctctttcctttgattttttttttctacatgtcttatagttttatatttaagtccttgattcattttgcgttagtttttgtataaggtatgaaatttatgtcaaatttcttttttctttttttgcctatagatgtgcaaatactccagcgccattaattgaaaaggctgtccctccttcatggaattacttttgctccttgtgacaaatcagttgggcatatttgtagggatcatttttcctgggctctctactccattccatttgatctctgtgtctctccctttgcctatatcacactgtcttgattactatatctctgtaggaagccttaatatcaggcagggtgatttccccaattttattctcctttttcaaagttatttggctattctcaggcttttctctttctaataaattttagaataagtttgtttgcatctacaaaataccttacaaagtttgacaggacttttgttaagcctgtcagtcaatttaggcagaatcgaccttttaactatgttgagcgttccagtccatgagtatgtctcttcagtatttaggtctttgatttccttccttgtcattttgtaatttttattttatatagatcctgtacatattttgttagatatattcataagtatcttcttgttatctttagagcaactttaaatggtgttgcatttaacagtcttgatttccacttctttgttattagtgtatagacatgcaatcagtttttgaatgttgatcttgtaccctgaaaccttactgaactatatgttttcctctcagcactgtctgagctgcatcctaccaacttggtatgtcgtgttgtcattttagtgcagttctatatagtttaaaatttcccttgagatttcccctttgacctatggattagttagaagtgtgttggttaatttccaagtatttggagattttcctgtagtttttttgtcattgatttctagttggagtccattttggtcaacatattctgcatgattttaatttttttgaatttattaaggcttttttttgtgacccaggatatggtctatctgagtgtatgttccatggacaattgaaaagaatgtgtattctgcagtttttgggttgaattttctataaatgtcaatttgatctttttgttggatggtgttgcacacttctgtatctttgctgatcttctgtccagtagttgtgtcagttgctcagagtgggtactgacatccccaaatattattgtgaatttgtcgatttttctcttggcaagatttgtttttgctgtatgtgttttgtggtctggggggtacgcatttagaatttctgtatgttcttggtaggctgggcattttattattatgtaatattattccttgtctttatttagtttctttactctgaagtctgcctggatattaatatagccacttttgctttctcatgattagtgttggcatgacatgtcttttcccatcctttactttcagtctacccatgttgttatgtttgaaatgagtttcttgtaggtagcttgtaggttattttttaaatccattctgccaatgtctgttatttgatgtagttagaccatttatatttaaaatgattattgacttgctagggtttaagtctgcattttatgatttttttccttctctttctcattcctctgtttctttttccttgccttcctatggtgacaaacattttttagagtcccacatttccttatttatactgtgtttgaatgtacggctttggatagtgttctttatgattgctgtaaatattatgtcagcctactggtgtcagagttttaccactttggaccctttaccctcactactttttaaatataattgtcttaagtatttcctccgtatccactgagtaccttatcgtatgacataataacttttgcttcaacttaaagtatgattaaagaacctcatgaggtgaaggacagtctagtcttcttctgttagtctctttttctgtttgaagacatttctttagcccttctttaaaggttggtctgctagtaataaattctttagcttctcttctcctgagaatatcttaatttctccttcatttcttttttttgatagcaaatttattgagtcataattcacataccatgtaactcatacctttaaactgtacaattcagtggtttttagtgtattcacagagttttgaatcataaccacaatctaatgtaataaaattgtaagtctggctttttgcatgtgatagaggggagaaggaaaagcagtctatatcatcttgctctggaactagaagttgatagtcttttcaagtgttttataaatttcaggttcctctctccatccctttatttttatttatttatttattttgagatggagtctcgctctgtcacctaggctggagtgcagtggcacgatcttggcccactgcaagctccgcctcccgggttcacaccattctcctgcctcagcctcccaagtagctgggactacagacacctgccaccacgcccggctaattttttgtatttttagtagagatggggtttcaccgtgttagccaggatggtctcgatctcctaacctcatgatccacccgcctcggcctcccaaagtgctaggattataggtgtgagcctccgcgcccggcccctttctttatttttaaaatgtattttaatttttagttcttaattgtggcaagagatacatacaaatgtatcatcttaagcattgtttaggtgtacaggtcagtgacgttaaggacattgacattgttgtccagctatcaccaccactcatctccagaatgatttcatcttcccaaaatttaacctctgcactcattaagcagtaattgtccattcccctcttttcacaccccctggcaaccaccattctactttctggctgtgaatttgactcttccaggtacctcacgtaagtggaatcctacaatatttttgtgcgtgactgacttctttcccttagcatagtgttctcgcaacgttgtagtaagtgtcagaattcccttgcctgtgaaggctgaataatactccaccgtatgtgtagaccacattttgtttatccattcatccatgatggacacttgggttgtttccacgttttggggactgtgaataatgttgctatgagcatgagtgtgcaaataatctcttggagatagaccctgcttttcattcttttgggtgtatactcagaagtgggattgctgaatgatgtggtaatttatgtttttaattttggggggaactgctatactatctgtccctgtcttttccttacaaacacgtgtggaagactttgaggcatttgacctgtggaacatctcccttcttattttggatgggtgcactcctggtgaagttcagcgtgtccctttgtcctctctctcctgcacattggcagctggatccagtacctttgctggacttggttccgtctctttcgcaggattagaggaagtgctctatgtctgttcacccatctttttgtgagcaggcagctgttgatgctcaatgcccctgttttgggtaaaattgtgtctccccaaaattcatttgttgaagtcttaagctccagcatctcagaacctgcccttatttggagaaatggtctttacagagcttatcaaagcaaaatgaggtcattagggcaggccctaatccagcatgcccagcgtacttccaagaagaggaaatgcggaagcagacacgtgcagagggaggatgggaagatgtggtgactccatataaacataaacacggctgtctcttgcccttcattcttgaacgctttgctggacaggaaatccttgagtgtcttaaataggctactctttttttttctggaggtaatcatggttgtcaaaaagtcttaagggtcagccacagtggctcacccctgtaatgccagcactctcggaagtcaaggcaggaggatcatcggagctcaggagttagagatcagtctgcgcaacatagggagaccctgtctacaaaaaccttacctttcatttctttttctttctttctttctttctttctttctttctttctttctttctttctttcttttttttattttttatttttgagacagtctctctctgccggccaggctggatccagtggcacaatctcggctcactgcaacctccgtctcgcgggctcaagcgattctcctgcctcagcctcacaagtagctgggattacatgcatgcaccaccaagcctggctaatttttgtgtttttagtagagatggggtttcacctataggccaggctggtctcgaactcctgacctcaggtaatctgcccaccttggcctcccaaagtgctgggattacaggtgtgagccactgcaccgggccttaacctttcatttcaaataaaaaggagataacctggaattctgtgtgggctctcagtgtaaagatagaaggacacacagagtgttttgaaacatgcccctccctgatcagcaggtgtcctgctgtgtcacatgtgactgtcagttcccgacccctcggccgagcagaaagggctttggcaaggtgtccggagttggaggtggcctctgggaggtttgctgcccgagggtcctgttgccgccaggactggtgaggagactgaggattgaaggggccaaaagctgacaaaattctgtgcgggggctgagtggcagattcgggtctgaatcatttcctggttcctggaatattcccacttaggtgccgaagccagaattggagggagcgtggcgcctactcatggagcctgccaaggcactgccagctgctcacaggccaggccgggcgggcagagcctcctcgctgcctgctggctttgaaattcatgtttgagacacacattccagccttcactgcttgttcaaggtgatacatgattttcagactggacagcttggcctcttgtctgttcttgtgttttcctttatgtaccaggataatgttaaacccttcccatgatgctgcaaaaaccaaatagtgcagcacacaccccacagcccgaaacaactgcaggtgcgtgtgccagtggttctgaaaggaatacagagacgtgtggtttccgaatccgctgattgttttattatatactgttacagatcatgttattctaaattacaaaataaaacttatgttaatatacatttatacaacgtatatattatacattatatagcatgtagtgatgtatgatgtaatgtatgatatgtactatataataatttataatatattataattattataataaaaatgactggccaggcaccgtggttcatgcttgtcatctcagccctttgggaggccgaggcaggagggttgcttgaggtcaggagtctgagaccagcctggggccacatagtgagaccctgtctttctaaaaaaaaaaaaaaaaatagtaatttgttattattcttcctattactatttttaagggacaattttggaaacatactttactttttctagtgtagcaaagaatttacattttgtcacctgaaagcgtcctggaaaatccatcctagtgtcttgtaattctaacagtcaccaggaaggctactttgagaaaatttcatatggtatgagggaaaacaagaacattctcatttttttttgtcttgctgaattaaaaaaaaaaaataaaagcaacaacaagaaaaaacaaagcccagggctggggttaagtaggtgaaggaggaaagggagtccccacctgccagtctcagtgccgctctttgccatgcacacacccgtatgtgtgcccatgtgtgtgcacacagacaccaccgggtccccttggagttaccaggcaaatgcatgtcatcagctgttgtgccttgatgtctcctaagctacatagaatcccctcagaccacgcctgacacccaggacaccagggcagtaatccgcacgcccatttcactctcaccatgtaaattgcgttttctattttcatttcattttatgtcacttttcttcaacaagtaattattctagggctttataagaacgctgtgctttcttagtctatttataatgagtaagaagttgtttttattctatttcttttctgtctgtgcttgccattttttttaatcacgattggataaggggggatccctgcaagataacagcgcccaccaaattagaatctccctgaaaaacatacagttaatcaggaggaaaatatagttgcccatagtccatgattatagcacaactaggggacaattaatgtagcaaacctctgtttccacccaagaccaggatacagggtttcagggccaggccagagccccgagccatcaggaccgggcacaggagagtgcagcagcggcctggtcccaccctcactcgggagataataagagacatctgaaatgtcactcaggaataaaagagagggtcttggaaagtgcatgggatgggagagtctgctcctgggagatgtttcctggaggtttggtgtgaaagggaagagaagaattagctgaaaataaggaacttagtaaaacaacaaatcatccacaaagaagagctcctctcaggggaggaggaggtggaagaagaggaaaatctctctccttaattaaaaaaactgtactttagagaagtaagagaagagtgcatggctgaaccatgttcctgagcaagccacacagacctctccctccctactgactctactcatcagcttttggggagtctaagtaaattaatataaacccaagcacacctagcgtccatacaatattactgtaagaaaaagaaatagaaaatgtgtagcaaaatgctggacatgaaaacagccaagaagcacaaatgaaatgtaagtaataggcaattgcaaatgtgaaaaaacaccatgagccagctcttcataaaataagactggaaatggataaacaacgggagatatgaaatgagagctaattaaggaaagcaaatgaagaaaagtctaagataatctctgaaattaatagtaaatgataaggttccccaaagggatagtagttacagctgaaagcacagtagggatagaaatgaaagaaatagaaaagatcaaaaccaaagtgtctgttggaaagacatccaatttacctgtaattggtgaccctgaagaactaaaacaaggcaatggaacagaactaaaaatttaaaactgcaagtcaagaaaactttcctaaaataaaattaagacccaaatctacatggaaatatagtccactgccattccgggaatggttgactcaagatttatgctctaggaagactaaattctaaagataaagagaatatcagcagggcctccaggcaaaaggaccaagttatttacaaaggaaatttacagagttgtttacaaagttacaagttatatgcaaagtctggtgtcagacttataacaacaacaaagaaagcaagacagcaatgcacaatacttttaagaaactcaaggaaagaaaacgtgagtgaaggattttatgcccagccaatggttctttaagtgattcagaaacaaaaatattgtgcccaccaggcacacttaaagaatcagctggcattagtgatatgtcagaggctggacggcagaaatggtctgccctggttgcaggcaatgaggagtttcatcatctgtcgataatttaaaaacaataataaaactgactgaaagtccgtctgctttttatgtcactgtgatccaacacttttaaacaatgtcagccaaaaaatactcctcctgaaaaaacctattgttggtctaatttctaagcaatttttcctattacaattgcattttaatgctatgtgtaaacctcaaattagcatatttgcattacttatgctttaataaacattatattctacatggcatttaatttggagaactcccaagtatacgatcagcccctgacatctgcagactgaggcacatgtgtttattttgagaggaagtttgtagcaatccagaatcatgcaaactccattgaggtccggactcctgtgaccctgtgtattcctctgtttggatagcagattaggaataaccagtgatatcacaataggtaaagacaaagaaacagaacttggatttcttcaattctgtcattctatgtgaacactagaggtttttattggtgtgtaaaatttgaagagtaagagcacagatgatgagattggatatttttgtttgattggtgcaacttgtagttgacacatgaaatattttactgaatatgagctgtaccattaggactgaaattcatcttttaaaattgtccatggtttttaaaattacagatccagttaaggaaatagtgattattactggttattatgtgataattactgaaaacactgttgtcacatagaggatgaaggtgttaaaaattagccacattatgtatgccacatagcaggggacaggcttcatccaatgaaaagatgatgtgggaaactttggcgaaggcactgatagtatttttacacttaaacaagtattttaaaatgtttaaaaaaaattgtatatgtatgaccgaaagaaaggtagggataagtatggaggaatggctataaatgttatatattctgacaaaatagaaataatgaataaaaataatagttggagtaggaagagcaaaagaggaacagagaatcagctcattgattgccctgcaggtaggaaagtggtaacattgtttggtatacaagaatgaccactgaaacaaaaatatagaccttaaatacccaaagaaatgcaaaaacaaaacaaaacaacttttaaagaagcaaacaaaccatatagtgaaatacacacggtcaatataacactaaagaatagaactgagaccaaacctagcagccgcatcagtaaattagagtggatttaacccatttattaaaaggcaagactgattttcagattggttcacatagtggcacccaactctatgctgtataaagaagtcatatccaaaacacagtgatccaggaaggctgaaaatgacaggagggtgtatagcaatgaagagagaaaaagagcttgggagttttaatcctgactgcagccaagctagtatcaggccaaaagcattaatggaaacaaagagggccgctgtcaatgctaaaggctgcaatttgcagagaagatacactaggtgtggttatgtctgcttcacataacatcaccagaacctctacgatgcggaaaccacaggggcggtggggagacatgagggacacgcagttccaggacattgtgactgccttgctcagcctgagacatgtgaaggggaccaaaacatacgcctccaaatgtaccagactttgtgctgtgataatagggaatacaactttgtttcgagactacttggaacacttaggaaagttgacatatattagcttacaaagacaacctcaatgagttccgtaacagaaataatacaaacaacattctgtgctcacaatgcaataaaactaaaaattaatcataagattaaaaaccaaaaaggcccttcaatttgaagagttacaagattaaactctattaaataagtttttaggtgaaaggaaatacacaaaccaagtgcataatttttgaatttgacgataattaaaatatatcactctgtggaatacacataaagctgtggttataacctcagaaatgaaaccaaacgaattaatggatttatcatctaactaaaaatgatagataaaaatagccaaataaacttagagtagaatgacaaaaaataagagtaagattggaaattcatgagttttaggaatgagaaaaaaatgaaactgataaatacacaaaatactacatcctagaaaaagaatcaagtggacaaacctctgtctaagctaatcatgaaggggagagagagagaccccaaacaacacagaataagaaatgacattaacagaacagagcatatttaaaaaaatcattaaaagcttactttgtatagtgctttgcaagtaagtgtgaagacctggatagaaagggaacttctttaggaaaatataatttattcagattgaccccagtagacacagaaagttttaaaaaaaaattcctactggaaaaaaattcaaatctatattttcacaggagaattctatcaaatcttcaaagaacagatatctcaatgctacttaaattattctagaacatagaaaaagaaaccttaagattattcaatgagaaaaccacacaccaatctcacttaggaatattgatgtaaaatgcctaagtaaaacagtattagagagaaccctttaaaaatggttttgagacaactggatagccatttggaaaaagataaaattttgtcgatatctttcatcatctacaagcatacatttcaaatgtctctaaataggtagttaccagaaaaactaccacaagaaaacatgggtaaattttaaaataacctgtgggtagggaaaattatgattcaaaatccaaaagcaatgtaaaaaagattgagaaatttggttgcattaggaaaaaaacaaaacaaaactgctttcgcatgatgggggagggacaccataagcaaagtgaaaaagccaggtaataaaccagtagaaaatatttgcatcttatatcacaaagctaattccttcaaaatatagattataacaagataccatttctcatgggccatattggcagagaggaaaaaactcaaaacaaaacaatacaagtttgatggcgccctctattggcgaggctgtggagcagccattcagattgctccacccctggaggaaacaggatgccttgggacttggtgcacctgcatagaccctgactcagccatgcctccttcctgaatttacctggaagacaatactccaaatccaaacatgctcatggcatatggagatcttaaattaataggtcctcttttatgtctttcaataaagtaacagatatgtttctatagaggtcttccatttttacattaaattgattcccaggtatgaaattttggctactgtcccagtggcagccctctggaaatgacctttgttgagtttgtgttttgacctggtatccagcaaccttgcttaacagtctgaagagcagcttggggcttttctctatggacagtatgtctcctgcatgtaatgacagttggctttcattcatccattgcaatcttcatcctttaatttctttttgttttcttacttctgtggttgggagtgacagaacagtgttaagcagaagcagttatactgcaaattcttgtcttattccttcttgtagggccatctctaatggtccaccatgaggtgtggagtttgctgtggacttgtggtagatcctcactttgttaaggaagtctccttctggtcctaatttgctaggagttttttctccctttaattgtgaatgcatgttgaactttatgaaatggtttttgggcatcaattgagatgatctgttaatgtgatgaattatgtgattgcgacaatagcttttctaatattacaccaagttgacatgcctgggataaacctgtatttcatcatgatatgtctcttaaaaattgctgggttcacttggctaatactttatttaggatgttttttcacctgtttataaatgagtttggcctataatttacctttcttattctgcctttcattggttttagtgtggagattatattagacccataacattcagcatctcatccttttctcttttggagagcaattaatataagactgaggtgatatgttcctcaatggtattgttaaaacttacctgtgacaccttctggttccagtgcattactagtggccagatttcaagtgactaattaaatttccttaacatttaaagtctattcacaatgaggaaataaaccttacctcatcagttggcttccttcaacactaccatttttcttctttcttgtgagtatgtgagccttagttcaggctgctataacaaaaatatcatagattagtttagagaacacacattcattcctcacagttctgaaggctgggaagtctaacgtcaaggggctggtgattcctggtgagggccctctgcttggtttgcagatggctgccttcttcctgtgctctcacatcggggagagagagagcatctctctcgtgacttttcttctcattcccattcatgagggcctaatttcttcccaaaggccccacattataatagcatcacattaaggattaggcttcaacctctgaatttgggaggagcacattcagcccttagcagaaccccacccccaagattttcctaagtgaatgaatagtcatcccccagccttgttcctggcctctaacagcattttagaaggaggtttctcatgactggggttggctgagatgggaatttcctgattccattggctgtgattcagccccatgccatcctgccagtaagatgaacacatgagtcatgctcagctgctagggtgcctggtgctgcttccagttcctctgggtgacctctgtccagcacataaacctcctgaagcattccgaatttgcggaaagtgagccaccctcccaatgtgtacatgtctgggcctaccttcctgctctcgtatgtgacaggcacacagcctttccagaaggtacctcattgcctagtacagaaatgctgaggttctcacaggagtgagaaccctactgactggctgttgtgtctctcccatacagtcgggtgtggagcagttggacccacatacctatctgcgcccatcctcagttgaaaggtagtgaacagcttgggctgtggactcaggcaggcctcggttcaaatcccagctctgccactcaggggctgtgtgtgcagataggctgcatctattgtccaaagccaaacatggggaaaaccaaacaatctctcaaaggggtgtggtgagggcttaggcaaaagactggtgtaccgtggctcggatggattagtttccattctccctctctctgtttccagctttcctctcactacaagatgagggccctgtccctcttgggcgtttgccaaaggaaggtctggacacccagcagctcattcatgtcgcttcccagtttgctgttaccatgttgcagtgcagaagccataagccgcatgatccgtgagcctggccctgcaacttggctcctccacacagcagcgtttgccttcattgtcacagatgactatgagaagatgcccttggtcatctttggtctgggctctggagttctgtagagctttgagccgccagagctaagggggtgaggcttgccccaggccggtggcacacccaggactgggcctggatgactttaatggtaggacagaaggaagagaaaggagctccccagagtccagctgctgggctgtgcagcccatttgcagtgtacttccaggagccttgatggtgaatgctgtaaaagggggaatctttcttccccacctttctttaaatcatagagctattgtgatggcttctgagctgcaatagaatcacccatgaggatttttgtttgttgtcttggcatgaagttcctgtcccttcacagtaatccggcaggtgcctcccagggcatggagtcattgtgtcacattcttctccaggactgcaggagggtgggcacagagttccacaacttgaaatgcagcagacagttgaaaggattctgctcacaccaggagttggattgtatttttccaaatgcattaagtattttaagcagcttgagctgcttaatgggcctgaaagcatttgattagtccaaagggctctatgcccggcaggtcaggggacaagaagttcttaaaatcctatgggtctgaccccttctgctctctctggctatctggctacaacgggtccccagggttgcagcaatagctgtgacctgcttatcttcccagaagtgctggaggcaagctgatccctgagcactgtgcctggagcactgcaggtgccctgcagccatctccatccacaccccctgcctggcctgccccgattccaggctgggcctcgggctcccctcccttcttcgtccccctcctcatctatctgtggctctttctctcgggccctaccaccaagccctctccttgccattctcttctgtccctcaagccgtattcctcagcatcacatggtcctcccgggtcccggtccactcctgtcatgtgagaacaaatggtgtctgctggaatttgcttcgggcctctgttgtgttttgagccaatgtgtgtggtcctcctaacgtcatttgattcatccggcaaaaggctctgctgcctgcctgtctggggcagagcttctaagaccctgtcagttttggacaatgaggcttccctgggggtgcagagtggtgaagctgtttggaatccttctcttgaggtggagtccagagtttcttcctgtcagttcctccccatttgtgtcagcagggtgctatgtccagcgcaggtcctcccctggcccctttctggccttgcagagtgcccccggccccgtgtgagcagatggccttctgggcggagcgtgcagtctcttggcagggcagccaagttgggggtgagatggacctagggctctctgaccccgtaggtttggcctaggctgagactctgagcaggtcacttacctctgggtcctcatgctcaggttcaaaatgagacagacagtggagttaagagatgatttttctgatccttctttgggtctttgcatcagttattttaaaaaaagagaaaagcaagccaacacaaccatcctcggctgattggtggagcagggcttacttatgtggctagttaaaagaaaatttatttttgaaagctgcatggagattttccgtaagcacagtaatgtgagccggggtcaaagctgtctttcagagacagggaagtgcagagatgttcaatgtaaattgtgccttttagctaaacacttggtagattcagcactggccgtgtaggtttgtcctgcttgttttgggggaaccagaaaagatctgattgaatttaatctgatttctgctagagtttggtcatgtaagatttgaaaaagtgaaccttcctgagccagagcaatcaggcaacaaagaaataaaaggcatccaaataagaaaagaagccaaactgtctgtcttcactgatgttatgattctatacatagaaaaccctaaagactttgccaaaaggctcctgtaactgataaacaacttcaataaagtttcaagatacaacatcaatgtagaaaagtcagtagcatttctctacaccaataatgttcaagctgagagccaaatcaggaacacaatcccatttacaatcgccacacacaaaaatacttaggactacagcgaaccaaggaggtgaaagaaatcagagatgacacaaacaaatggaaaaacattctatcctcatggattgaaagaatcaatattgttaaaatgaccatactgcccaaagcaattgacagattcagtgctcttcctatcaaactgccaaggccatttttcacagagctagaaaaaactattccaaaattaatatggaaccaaaacagagccagatagccaaagcaatctgagcaaaaagaaaagccagaggcaccaattaccaaacttcaaactatactacgaggctgcagtaaccaaaacagcatgggactgatacagaagcagacacacagagcagtggaaccgagtagagaacccagaaataaagccacacacctacaaccatctgccctttgacaaagctgccaaaaataagccatggggagaggactccctattcagtaaatggtgctgggatagctggctagccttatgcagaagaatgaaactggatccctaccttttaccatgtaaaaaatcaactcagttggattaaagattcaacctatgagaatcctagaagaaaacctagagaaacatcattctggatattggccttgggaaagaatttatgactaagtcctcaaaagcaattgcaacaaaaacaaaaatcaacaagtggaacctaattaactaaagagcttctgcacagcaaaagagtaaacagacaacctacagaatgggagaaaatacaaactatgcatccaacaaaagtctaatatcacaactctacaaggagcttaaacaattgaacaagcaagaaccaaataacctcgttaaaaattgggcaaaggacatgaacagacacttctcaaaagaaaacaggtaagaagccaacaagcatatgaaaaaatgctcaacatcactaatcatcagaagaatgcaaatcagtaccacagtgagataccatctcacatcagtcagaatggctatttttcaaaagcaaaaaaaataacagttgctggcaaggctctgaggaaaagggaactcttacacactattggtaggaatgtaaattattcagccaccttggaaagcagtttggagatttctcaaaggacttaaaacagaactacatttgacccagcaatcccattcctcagtatatttccaaaagaaaataaatcactctaccaaaaagacacatgcacttgtatgttcatcactgtggtattcacaagggcaaagacacataatcagtctaggtgcccatcagcagtggactagataaagaaattatggtacatatacaccatggaatactatggagccataaaaaagaacaaagtcatgtcctttacagcaacatagatgcagctggaggccattatcctaagcaaattaacacagaaacagaaaaccgaataccacatgttctcacttataagtgggagtcaaacattaggtactcataaagatggcaacagtagacaccaaggactactagagggcagagggtgacagcggggcaagggttgaaaactaactgttgggtactgtgcttgttacctggatgacgggattaatcataccccaaagcttagcatcacacaatatacccaggtaacaaacctgcacgtggactccctgaatgtaaaataaaggttgaaattagtcaaaaaataaggaaaagtgggccttccccgccccccacacttataaagagttaaggattttgtgtttattttaagccatgttgaactcagcccaacatattgacacaaggcaggacttagtgcagtgtcactaggctttaattttgttgccctttgggctaataaagtcaggttatctcactgggctgtttccttatccattaagacatttgatgtaactaagtacccatcctatggtgacataaactttttcttatgtcattggaaagtccagaatacctggttgcaggcaaggtttgatctagcagcttgaccttgttagcacaggtccagtttctttccctcagtcctccctggtattttatcagcttcatcctaaggctggttcagggaagatattctgatgatatatatttctgctttggcaatggaggatttatattcgattgtcagaagtcctcatgtcctatttaaagtctagtcattggaaaataggttgataaggatggacctgaagaaaataaagcagcaatttgtcatgacaaagcaagactaggaagaggcattggaccagcatgaccaattcaaggacacgttgatgatgtcttcagcgcaagtgttcttcccaagcttgggggacctggcagggctgcctacagggctggtgtccagcctgctctatagaaggcgaattagagatcgcaataacgggccagcttccatgatgaccccaggttgtagtgatgtctatgtagaaatgaaataaatgcataattaaaaccaaaggtaggcttgcatttgggttgaggtcctggcacctacggaggccacaagtgtgtcagggtggaaggtaacttggtgaaataggaagtcactgcctattgcccactcatgtccccactgatggagttagctgggggatcccctggtgcagaccctggagaggcatcactgtcttccttgttcagtgggcttgggtcacctgcatgaattctgaggttgggaaggtgtaaacatttccctcaacacctgcagcccagccgccgtctccctgggtgcttcagtcagccgtcacgttggggaggcgtcatgtaaggtggtccttgtctgagtagaacctgattttgaaaatgaaattcatttccttgccttcattttccagacgaaaagatatgtatttgtggtgtgtgtgtggcgggagagtaattggctttggttttgacaaggaggacaccagagtcctgttctgatactcagttttgggcccatgcgtgacaattctgtgtttcttttcagcatttgccaatacattattttctagagtctctcccagcatacggaaaaaccccaaattcaaatttgacttttctcttcgaggctggttgtggcatgctgaagctcccaaggcatgtaatgtagtgaacaaggtggcctccaggagcgctgtcggctcatgggccccacccacccacctcgcggtgtaggaggatccaccaagtcactgtcagagtgggttggagagacctggcctggggtcagctctgtgggcagatgggccctttcccccactgggtggagtacgctccttagtagcccaagacagaacattgccttctcccgagaaacccacctctggggaaggttaggccatgggatctgcgggaagggttttaggagtagattaatgggatttgtgatcccaagcacccaggccactctgtggtccccacccctgggcttgagtcctgctgaggtataagtggtgctagaagacctctgccctgccctgccctgccctgccccaggaacctggctttctctgggctaatgagtgtcctctctgaaggtatccagaggccgtgcagacactcacactttggtgtgaggcgtgccctcggttgatcagttacactgctgtggggtgcacaggtggcaaggtgggggattctgggatcggggaggctagtctgggtgtagggtcctgccctggaggggctcacagtggggttgaaagcaagctctcgaggcgttattattcgggactctgagtgccgggccatgctgggggagtgagggcagggggagctgcggaggcagggctctgagggctttagaacaagagccggtgtgtgtttcccactgagtacctgccggcacctcatttatgccacgtagcaaccccatgacataggcttataggggactataattatccccatttcacagctgggagaacctaggcttagtgtcacagaacctaggcttagccactgggtggctgatactgccacccagttctgagccagtatcagcttccagccccctgactcagtctctctgctgtggtttcctctcaagtgccaggatccttcctggtcccgtttccaactcagaccagtggaggggcgcgctgtggttaccactcattagaagagaggcagggtctctctgtctctctctgggtgtcccccactgccatctctgggtgctgggggagctgctgtatatctctctctgtctatccctatctctccctccactgccatctctgggggttgggagagctgctctgtctctctatctctctccccccccaccccactgccatctctggagtttgggggagctgctcgctctctctcccccctcccactgccatctctggaggttgggggagctgctctatctctctctctctctctctctctccccccactgccatctctgggggttggggggagctgctctctctctctctctctctctctccctctctccccctccgccaaccactgccgtctctggaggttgggggagctgcctgggatgcagagcggcttggattggtgctccctctgcctcagtggttgagctgacctctgtccagtctgtacacattggatcctgaggctgagcttgggtggctgtggcaggaaggtttggtgacatcacacccttcaggcttgtgtctgtctgagccaggctctgactggctgggagaagaggaggaggtggggttctgggaggccctgaggctgagcacggctgctgtgctctgtggctgcactgcaggggcacgggctcagcatgttctgggccagggcacacaatgctttcagatcaggctccagcaccccacacgccccttcatgctttgcactttttgtctaccagccagagggcagtgaataatgagaacaaacaacatcgggtccagattttcgtggtcattttcctaacaagccgaggtcagagagcactgaaaggaggcctaagtgcttctgccacctcagctgactgtttttcaaaaaggaaagcatgcgtgggatgtgtgtattaggtgttacggtgatgtctgttgtcagatcatggccagaaaaggggttgtttcaattaaaatggattttggacttcgtttttcttggaatgagtaaattgagggaaatagcacatgttgagattttggatttctgctcttagaaaggatttaaaataagtggtcttcagtagttccacagcggatcttcgagactggtacagatggggtctcctggatgtaacgagttcttgctgctttaactggatccggttgactctgtctgaccagctcagctggttcgttctatgaaacgcacttctgctttctggaatctgaaggaaggagagagatagaagacaaagaaggacagatgtgttggtggccagaccctggcttctgaacagtccttcctgatggcttcaggacctgggaggagcggcggagcaggtggctgccctgggcttgccagacacctccattccagcaagatcctcctgggggatgtggtgccctccctgcctctcaggcacaagcatatgcttgtttggcctaaaaaagtctccttaattaaaattaatatcgtaatgcagtaaatccttctgcctcctcttcccctgcccagttacaattcccggcggctctccagcccatagaggaggcttctcaaagtttcctgcctcctggaggagagaagccattccccgatcacccaaaaggacaaagtatgtgcccactctgcgtccttgcttgtcactgcccaacatctgcaaacattaactaaagtgctgagcccattcaggtgtaggactcactagttggttaatgtgacagacagcgtttcctgtgccagcgctggctggtcacttcctgtcatccagcactcttgagtgttgcagtggatgcctgtttcgtaggaacactcagcctgttccgtaagaaggagcgccacttctcagcctgtacttagcaggtcactactgttggccactctgcttttctttttaaaattttaattattaaaaaaattttttttgagagtttccctctgttgtccaagctgaagtgcagtggtatgatcttggctcactgtcacctctgcctccctagtagctgggattacaggtgtgtgccaccacgcctggctaatttttgtatttttagtagagacggggtttcaccatgttggccaggctggtcttgaactcctgacctcaggtgatctgcctgccttggcctcccagagtgttcggattacaggcatgagctactgctcctggtccccttcttatttttatgttagtctttggaaacaattggcatatattttagtctgtttaggttactgtaacaaaataccataaactaggtggtttacaaacaacagacatttatttctcacagttctggatgtgggaagtctaagatcaaggcgccaacagatttgctgtctggtgagggcttcctggttcatagaaggccatcttctcactacatcctcacttggtggaaggctcaggagagttctctggagtctcttttacaaaggcacaaatcccattaatcacctcccaaaggcccactgtctaatagcatcactttgggcattaggttttaacatgtgaatttggagaagggcaggcacaaacattcagtctgtagcagcatacaaaaatgtaacaagaataatgtgatgaacagctaggtatccacaagctgctaaaggtagagaatactaccatattggttacctatttctgtgtaacatattatgccaacacttagtggtataaaacagtaaacatttattatctcacacatagtctgtgggccaggaatatggaagcagctgagctgggtggttctagtggaggggaaagatgtgagctggggcacctgaaggcttgactggggcaggaggatccacgtccaagatcgacttcacctggctgttggctggcaagagggctcagttctttgccatatagacctttccacagagctgcttgagtgtcctcacaacatggcaggcggattcccccagcctcagtgattcaagagagagtatagagagagtagagaggaagccgctgtgccttttatgacctggtctcattagtcatacactgtcatttctgcttatgtctgttcactagaagcaagtcactaaattcaggccacactcaaagagaaaggaattaggttccactctttgaagggagtgtcaaagaatatgtggagagagatatatatatatatatatatatattcttttttttttttttttgagatggagtctcaccactctgtcacccaggctggagtgcagtgatgtgatctcagctcaccgcaacctccgcctgccaggttcaagtgattcttctgcctcagcctcccaagtagctggaatttacaggcacacaccaccacacctggctaatttgggtatttttaataaggcagggtttcactatgttggccaggctggtctcgaattcctgacctcaagtggtctgcccgcctcagcctcccaaagtgctgggattacaggcatgagccaccatgcccagcctgtggatgtattttaaagcatcataacaccattgcagctagagcccctccccagttgcatcttgtctttcacacagaggtaactactgttgaagtttgatccttgtttatggcctagtacatgtataagtatttctatccctgttagttctgcattttgtctgtaagcgttatgtaaatgatatcaccttgtatttttttctgtagtgtgcctttttttttttttgagatggagtcttgctctgttgcccaggctggagtgcagtggcgtgatctcggctcacggcaagctccacctcctgggttcaagcgattctcctacctcagcttcccgagtagctgggattacaggcgcccgccactgcacacagctaatttttgtatttttggtagagacgaggtttcgccatgttggccaggctggtctcgaactcctggcctcaagtgatccgcctaccttggcctcccaaaatgctaggattgcaggcctgagccaccgcgcccatccagtgtgccttttttgcttaacattatgtttgtgagattcatccatgtgaaaacaggtggctgtatttcatgcattttcactgctgtgtggtattgcattgtacaaacataagactatttgtcgttctccattgatggatgcttagttgggttcctgtgacttgctgctacaaacaaggttgtcttgagtactcaggtatgtgtctctctgtgaacgtgagctggatttgtcagtatatttagcaaggattggaattgctatgggagagagtacagtaatcttcaaacgtactagaaacagctaaattttattccaaagtgtgtgggtgtcctcatgagtggtcccactgacagcgtatgagtttcctcttctcctttttcttgacagcacttggtgttgtcagacattttacatttttgtctaatgcgtgaaagtgctgtctacatgaggtattaatttgcatttccctgcgtgccagtgaggctaacatctttccatgtatctattttcacatatatattttttcatatatttggtattctgtgaatgactggccatatcttttgcacctttttttctgttttcttattgatcaatctgatccgttgttgagtttatgtaccataaatatcttttttcttttcttccttctaacataatgtagaagctaagagtgtggattctggggccacattgccagggttaaatcccagcttcaacacttcctgtgtggccttaggcttagtctgtgtatgcctcagtgtcctcatctgcaaaatgggatgatggctccccacggtgggcctgggaggatgcgcaggttcgtatctgtgaatcagttagtgcctgtcatagtaagcacaagatagactaatgcaacctagtgtgctgggccctgtgtggccacacggggctgtatgcacaggcgtcaccatggccagagctggagctcagatgtgtctgagaagattggcagatgctgcttcactctggctcccggtctcctgggtggccctgcttccatccctgagctgcctgaacggaaaacgaaatcccatccccgctccagggggtgcctgggaattggaaggcatcaggctcctcacagcaaaaatagaagcctcatttgcttaggagagaacaatgacgaggaggcaagccagcagaggcggccttggcgggctgtgtacaccctctgcttgtctccgcactccctggggtcagacgtagacgtggctaagctgcctgcagaccttctcttccccttcatcctggcctgcagtgggcatcagggtccatcctgggacgtgggctgtcttggcaccaagttccagttcttaatacctcagtgtcacactgttccctgatttctcaaagccaggaaggaattgcagaaaacaaggtcagtttagtatcgagaatcactggagagccgtgtcagagccctgctgagaagggcgcggggaactgtgttcctgtctacctgatgctgtgggctgcacaaggacggacttactgaagattacaggccagggggaagagggcacgtttagtgtcaaccctacacagaagaagttagctccgctgggcgcggtgggcactttgggaggctgaggcgggtggatcacctgaggtcaggagttcaagaccagcctggccaacgtggcgaaactgcgtctttactaaaaatacaaaaattaacctgttgtggtggcatatgcctgtaatcccagctactcgggaggctgaggcgggagaattgcttgaacccggggtgggagaggttgcagtgagctgcactccagcctgggcaacggaaactccgtcttaaaaaaaaaaaaaaaaaagaacaagtcagctcagccccactgcaaggagctcctgggtttatttaagtgagcctcagataactttacataaaagcaaatgtgtaaaaagcgataaagtcagatatattgaacatttgtcctgagggcaaatttctgagctctaaaagccagtttggttttagataacatctgtgagtctggaaacaggctgagatactctatatctgcactcccaactctgcctttggctttgtgagccctgtggtctccttgaaagaattggtccccagtgggtgaactaatcacccatgaagagtctcccaattcaaatctggaataaaaagtgaggacatgggggcagaatgttactcatcacatgtggcccgtcagtactagacttcaaggtaagtttccaagaacagagctctgtgaccattttcatgatagcaatttgtacattattactaagtaattttaatgccgtgtttacaggccaccttcccaaacaaaacaattgtttctggaagttagactcttgaagacttaacttttaatccagtttgttctcaaaacatttgcacaaatgagagtcttgaggtttgagctttctattctaaaggctcagcttcttgcccaggagaaaaataatacatgctcgtgtttataaataagagttatggcattggagtcctttacattgcagccagcctagggactcagttattcagaatttaaacattttacttgtaaagagcactttggtatccaccccaagggccctcctctgcctgtctcagcaccatctctgtgtgtcccatcaggaagcaacagacaactccctaagccccacagtaaaaacgtctctcctggtctgggggcgcatccatcccccatgtccccagtcccatcctgggtgttctgggattccagccacagctgtggggacaccgccatctcactgcatccctcttgctcttgcggcagcttggctgagctacagggccgggccgcaggaggcgtccttgtgccggagctcaccttgtgccggagctcaccttgtgccaggtgttgagctctgccagctgcccggccccactgtgaggccgccccttgcaggtgagttcactggcagcccagccagcccacgaaggccatgtgagtgtgaacccccattacaagctttccctcatgagatggcgctgatcagtctgggggatacctgcctttcagtatgggctgcagccattaggctggtaccaggaggagccaggtcgagctggcactggggcgacgctctgtctttgatgcaccctgatgcctcccccatcctgctgaccatggtgctcagcacagaccccttccaacccatcccagggcctctgctcagtgtggccagagcctcctgtcaacaagtatgtcactgccttcgggttattattgttcaccagattccacttgctctacaacccaggcacagtgcaccagagtttcccaaacctgtgtgccgagtgccagccccttagcaagtgcagcgttgcccatttcactctgggaaatgcagccatagctctggggccagctagaggaaggagtgtgattgtgccttcccgggacagcttccaggtctgggagtctgtgatgttgtgagtgttgccttagctttgctaagaaaatgcttagggagatgggttccttcacccattcttccactcatgtgcctttctggctccagggctggtgtcccctgctttggaggggacgctcacatgagctgccctattggggttccgtcaagtttctcttagcctaagcggcttcctgtctcgggctccctccccagccatttgggtcaccttgggtccctgaggatcgcttctggatcttggaccccctcaccaactcctgtgacataataatcaaaggtaatcaggaaatgtatgaatcgtcttctttaaggaatatttagcatttctgctcattccagagtccctggaagcatggcatttcaaaggcttggttagatcacaagtccaatttactgccagaaatttgcacgtagaataatacagagcctatgatggcagttgaagtggtatcctgtgagaaaattaattagtcctgaaactaaatgccgacagcctcagcaaaatattcatgagagaagcaaacctcgtgcgtggtgtttgaagtcaggcagctgaggctgtgtactggacgtgttctctgtggctgagttctgctgtggattctgggctagtctaggcaaggcctgcctctccttctggactggctcccagggctgggggctcaggaaggccctgcaccctggagaagaagggagcccctgagactctttggccttgtatttgtgtgtccctctgggctgcagggctgcagaataaaccagctcccaatcctccaaacaaaaataaagacctgtgaatggctacacttggagagcagagtgttttgatatcatggggagacctgtgtacttaatttacggcctgaagattgagaaggatttaattgttccaaaaatggtgagaaaagagcaggtcccagcctttctgtctgatcacaaacagccgagggggactggggaagtggcctggtcctcactgcccctggaggggcaggaagaggatggagtgatgtgcttggcagatgcaggaatggccaggcagtgggaaaagcctagggtttccaagccatgtctgatcctctgtgttccttctgcctgctgggatggagcccgccccccaaatatgcctggctcacttacgactcagagtcagctgcccccagggacttcccggctctcgtgaccttgctgggcatgactttcaggggagccctctgtccaggagacataggtcactcgaatcacacagccgtgctttagtgaatgctagccaggggccctggagagggcaaggacaggacactcctgcatggaaacgaaaatgaatatttttctctgcagaaaatgaaaagtggtgctgggtccaagtggtaggtgacctggcttttgagcgaaaatgctgctgggaaatgagagaaaagaaacatgaaaagaatgcaaatgagggtggtggacaggggcccagaggcctgattcctccaccctccgcaaaggctgggtgtgtgatgcctataaatagacactcaaaacccgttctaaatggagtgaagacatgggcctgcttcctcttatggaaaggccttacataaggtgcagtgctgctattgctcctgggcggtgtgatgattctgtgcctttgtcggaagtcagtgtgaagcctgtggggcttctgggggatgcacatggatgagctctgggctttctggagactcgcagactctgggaaggaggcggtgggcgatgggcaggtctcctagggctgggaaacagtcctgagacaggctccgggtttcctgaggcgcttctgggccaggagcaagtgggaaaagctggactgcagggcttggtcaagtgacagctgcccagagccggagtttagggtgcctggagaggacaggggctggcaggcctgactttctcactgatccacttggggtcacagagccaacctgtaacagagtgaggaactgaggccgcattgctggactcccagtggaggattcttgctgctggactaacctttagttcatgaactcacccagaaattacttatttttggaggaccgcagatggcgagcttaggagtgaagaagggaatactatttgatgctaatgtgattccaggcaacattctagaggttcccttgcaattcaccttcccagccacctttgaagtagttattggccagttttatacacgatgaaactgacagagatggtgtgaagggattttctgacgttcacacaggaagcaagcagcccatgctgactccactgcggaaagcgtgtgtgtgattgacatgctttttgtgtggtgctcactttgggtgtgataaagaggcctccttgcaaagggccaggatctgtgaagcaccatgttgcttcacagaacaggccgtgaaaagccacagaagcaccatagcctgggaaagaaatggaacaacggtgcaaacagccagtttcccctgagcagaggcaagcaggttacggctctgcagctcccttaacgggtagcttgttcaacatggaaacatctttagcctcctcagagacgttgggtcatctcctttacatggggaccagaagtatcttccctgggccattttgggtggaggaaatttcgtaattataaccctctgctaggggtgtctacctaggaagtgagagcaactggccgctttcttagagaagtgaagacgctgagtagactaaacctttgtgatgaagtcgaagccactgtgttgcctgtgtcctgtttccttccccagtgaatggggctcttccctacgactgcagaccccaggaccagattgcaggtgccctgtccagcagcgcagccattcgtgaagggctcgcagcctggcccggctcaacagctgatgcccccgggaggaggctgtattactatcctttttgaaaggaacacagaaagccctttgtaactttgtctgtagccaacatggagggagaggcagaattcagatgtgatgttgcagacaattgaacacccctcctcctgttccaccccagcttcctgcccgtagccttctaatgcccttgccctgaattcctgatccaacccaagggcctggccttgaaacccccgagcctgctggcagtagcttcctcttcagccttcctgtgcagagcttcctctattcagggaagtctgagacctggtggcctctttctcattcttttcatgaaaccatcttgcccaggagaaggtgggctgagaccctgggcattggaaaggagaggtggtcctccttcctctcttcactttcatcgcagtcctctccccgcccacccccatatgcacaccctccgcagtctgaaagtgtcgtgaagcaccagctctgcaaacccgtggggtcaagctttgttgtgggaaaatacatattcatgagggctttgaggagcctcattaaaatgcagagagtctctcctttcagaatggtacataagccatctctttatttgcccaacacattgttcttaaggcaataattatgcgatgaatggctaaagaaacattttaattatttgtttagggtaatttctgattatctcattagaattataatctgtccacttttacaggtgattcaaagcctcatatttacatttttatacttgaaggagctctatgtgcgcacctgtatcattgctgaagtgaaagtaattttctctgttttcttctgctttattccagaaagatttgatcaccaggagatttttcgggacattaccaaaccactcattttaggtaagaaatacaaggcagcgttgcatggaatgaggttttgcttttgccatgtggggagcggaccgtttcactggagggaaaatgctacattgcaggcagagctggcaactgccgtggctctttgttttctgggatcctgtgtgtgtgagcttggggagtttgaagctggggtttgagtcacagccaaggagtggatggacactggggacgcttctggcacttaccttgcccggaaccgacctgcccaccacccaatgacaacacagcaagacacgcactccccatctgtcctctcctcattatactggtgtttctgtaaaccatggtcctcaccagactcagtcattgatttgtgtaacccctacctaggttcctagttacagcgaaagtagacacatgtatatcggcaataataggtagcactcgaacctttcactctccagtgtgggcagtggctggtctactttgagaagggaccagccattgtgagataccaggaagctgagcagaagaaatctaactttgataaaaagaggcctcctcatcttgccagggatggagcgtggtccatcctccctccctgtgcatggagcagtattgcagccctgaagacactgccccatggtcagcatctggcttgcccttgccctgtaggactggtaggaacagagccctggtgccagccgagtgttccacacaggggagacttgcaagggacaggttctgcactgcagatgaattggctgtcttcttctgtggctggagacacacaaggcagcggctttgtagggaaactggtgtacagggtggggcgtgtttggagaacgaggagcagagggcattgttgctggagttaaagaagcagagccagggatggtcttcatgtcctgatgcccagagcaggcctgagcttctgatggattctgggggttcttatgtattcttgggaaggagcatgtggtaagcttggacagggaggcagttcagagtgttacatgcaaggcagcggtggccttgggaacaccccccctgcctgaccaaggcaaggaacactttgtgtgtcccagtgtggaatctctgtgccagttgtgaggggacggatgaagaccagcaggggtgaggacgggattctggagtgtcaagactcaggttcagaatcacagtttttcttccagggcagcacaaggccacaagtgtggctatttgaagccacccaaaaagccattatttgtaaagcaaggcagctttattgatttcactttctgccctgcatctttcccacattgtggtaaccactcaccatccctgttctgctgatgaggcaggaattcccttgcatccagttggggagcattcttgtcacaaatgtcctggatgaattacacggtggctctccgtggagggagcacattcacaaggcatttaagagatgcaggacaatcagccctcgtccatgaaacagggtgaaacgtagaagagctgcgtgattattaatgggtttggacataagctggagtgtttactgaaatttttctcagttgtcagttttcaaagtttgtgaatgtacttttgtgctctcaacaggccttttctgctctatttaactttctacttagggttgtaaacatacttcagccgtaatgacattagatacatcatccactctcagctctgaaaatgctggagattttgattatcaccagcagtaaggacagcttatgaagggagatgttacttatggagacacagctcatgattccataaaattccagtcttctgggagcccagggttaagcagctgcctcagcccatccaccctctagggactgtccacggtgaaattggcttcttgacgttttccttatggaacctggggtgtcattacattctgttagagtcatagggtggttctatttatgcctgtaaggtataaggtatttttttcttctgagtctagaaaagacctactggaatttttatgtatcctgaaatactattagacgatcaaaatcaattgcaatagagaaggtgctgggctctcttcccaattgctctcacccatctgcagtgtaataggcctatcatgtaagtgaatatactcatcacaattctctgcagcttcccagcagaaaagcatattccttctcagagagaaaggcggcaaggagatggatatttttaaatgccaattatgccagaatgagtctctgtgaggagatctgtaaagagaagaaagggccggggtttatttatttttctgctgcgaatggaatcattctgtagcttcagaatactaatccctgtgatgtgcctgatgtcttttcataggataatttgtgaatgtgcttccacttacaggaaaagtttgaggctcttttcttattcttctttttcttttttttttttttttgagaattaaattctaggcctcactatatcctatgataaccgtcctataggccctcgatctataaaatgtgtgcataatgaaatatataaaatcagcgattatcctgaaggaacacagaaaagattaataagctgtatttaaatcacggcaagtctcagaacatatattaagttagaagacatcacgtcctgaaaatgacgggctgatgtgatactagcatgtacccccgtatggatgcatataaatgctgtgtaaaacctagcccaaagtgttctttaaaacctaagatccaaagaaaggcatggaaattccaagctatgagacatgaagagaaaacacaaagccagagcactaagggaggaggccatgagacccccaagcagtgaggttcctgatggagagccaggatgatgaagactgtgtgacatttgtgcagggagagacacggcaatggctgggacagggtagcaaggctaggagcaagtgctcatatgtataggaagccaggaggtggcagacgtgtgttatggaccaggtgggatgtgatgcaggacagctggttggccacataggaaaagagaaaagataaagtgagatccctacctcacagcacatgtaccagtaaacggccatagaattaaaggcctatgccgggcacggtggttcacacctgtaatcccagcattttgggaggccgaggtgggcagatcacctgaggtcgggagttcgagacgagcctggccaacatggcaaaaccccatctctactaaaaatataaaaaattagctgggtgtggtggcggacatctataatcccagctactcgggaggctgaggcaggagaattgcttgaacctggggggcggaggttgcagtgagcgagatcatgccactgcactccagcctgggtgacagaatgagactccatctcaaaaaaaaagaaaaaaaaaaaggccaaaatgtaaagacaaaaatgttaaaatacatagaagattttttctatctgctcttgaggtgggaaacatacacacatcataaaagaaaagatggattaatcaaacatcagtattagcaacttctttaagagaactacaggctggaataaatattcatgatgaatttactgtgagagatttgtattctgtttgtatcaagaactctttcaaattaattttaaaaagacaatagaattgaaaaatgagcaaatactatgaagaagaaaaaatgaaaatgtcaaatagacaaatgaactctgccttgctcctaatctgggaactgcctgggagaccatgagatgttggcaaattagaaagtctgataatcgaagggttgcccagagtgtgaagcaagggggccttcatgtcctgtttatcaagggcaagttagtaaacccctttagagaacaattaggtgttatctagtaaggttgaaatgtggatcccccatgacccagcaattctgctcatgaaagggattcagtgttgtattagtcagttctctcaaaaacagaaccaataggatcagtttatcttagagtttatgtatcgatcaatcgattgattggtcaattgatataaggtattggcttgcatgatatggcatctgggaagtctcacaatctgccatctgcaagctggagacccagggaagccagtattgtagtgcaaaggcctggaaagcagagaactggtgcagattccagtccaggccgaaaggcctgagaaccagcagcatggagggcagagaagaccaatgtcccagtcaagcagtcaggcagagagtgaattcaaccctcctctgctgttttgttctatgcaggtcctcactggagtggacgatgcccacctacactgaggagggccgtctgctttactcagtctgccaattccaatggtaaccgcttccagaaacacctcacagactatccagaaacagtgtttaaccagacgcatgggcaccttgtggcccagtcaggttgatacataaaattaaccatcacaagtgggtcacaaccagcgttttctaaaaatatgaaccagattagaacagaagatatcagagtttgttctgcatagtgaatgatagtgatcctgagaagggggactttgaggggatgggactgacagcgatggttaagcctgaatggaggtttgctacattgttttctatacttctatgtatttgcaaagttgaggagaaaagaagttgtggtaaacccctggatgtaggcacacggaccccagtgttctgtgctgtgggtccctctgatgcagccgtcttgctcccgtcttgctggttcatcctccaccttggctgactacctggcctcacccttgtacaggtgcttctgtttgtctcttcattgaaatgggtgggatttattgatttatttagagacagggtcttgctctattgcccaggctggagtgcagtggtctgatcatggcgcactgcaaccctgacctccagggctcaatcaaccctccctccttggcctcctgagtagcagggactacaggcatgtgccaccacacccagcttatttttatgtattgtttttatagaggtgggattttgccatgttgaccaggctggtcttgaactccttggcccctagaatgctaggattacaagtgtaagccatcattccctgtgtgaaatgagtaggatttctgaatgagccaggctttgcacattgacctggctctgcctcttgaactgctgccttcacatgggaggctccttctggccctgcctgtgtggctgattcctctctcaggtgcttctctttatcttcacagacgaggctcatgggcttcactttttgggaccttaggtggacatctgagtccacagccctcctgcctggcttctgtctctgtggatttgcaggcctgcttgtcccatatcctccagtgcccagcccagtgcctcatgtacagtggatgctcaagaagtgtgtagtcatcacatagctctagtttcttatttttatttttatttatttattttttttgagacagggtctcactctgtcacccaggctggagtgcagtggcatgatcataactcactgcagccttgaactgggctcaagcaatcttcccacctcagccccctgagtagctaggactacaggtgagtgccaccatgcccagctaattttaaaatcttttgtagagagggcatttcaccatattgttcagactggtctcgaactcctggcctcaagtggtcctcccacgtgggcctcccgcagtgctgggattacaggcatgagccactgcctctagactttagaaatgttcagaagctcaccttcccatctgcaaagtggagactcatgagttgggggcgggtagattgtgagaatgaaccacataatgaagaggggatgtgtagcacatgtgagttttcccatcttgctggtttccttccctggaagaggcaaagagaggacaaggagctggctgttactatttgcttgcagacttggtgtgtgctttcaaattggaagctcctgctctgacacccagttcttttttgttttaagttgtactttagaagagaaaaaaattcatcaacacccttttttttaaaagatggaaaatgggttaagaaagtagcacgaggaactgtgagcccaacataattagtgtgatgaaagagaagttagccatttctgtatgtaacttttgattaatgatattcagctctaattaattatgtccaattctaattaatgacattagtgtgcaagctggcattctcaaactatattctgaggattcccagcggatgttcttgaatataatagtccccggtcacattaggttgggaagtgctgtgtgtactgcccgtcttggacactcccaaagcaccatataaaaggccttcagaagtcctgcaagaaaaggaacaatttaaatttcttttaacctgtcatttcccagacttacttttaccatgtgtgctgctaggcacatacggacatgctaatttaactctcataccacaaggtgtgcttggatgaattgatgagcaatgtacatgtcatggagacgttttctaagtcttccagagtcatagcaggggtctcctgtatcgcagcagagcatactgcaaagaattgcatttccatacagtctagggctgctgtgaactaatctcctttcttgggcaaatcgcttaatctccttcaatcagttcatacatctgcagaggaaagggtgatggcatgccaccctggatggtgggaggactcctagcagtggtggctgttaccatctcataagaaaccctcattacaagaaagtccacgtcatttgccatgtgctggtctcggggggtcagcgagtggggggctgcagggagagaccaccagttacctcctgagcctcacgtgtggggtacactgtgttttgtccgttgttggatttgtattcattgttcatctaaaagtgattatgttgaaaaacagaatggtggcagacaggcatgtttggcatgggttaatgcgaggctggaaagagagcccctgaccttcagttcgagaatcagccactgcaggaaagggtggcgtcttggtggccgcatactgtgaatgtcaagggagacgaagagtgcaccctggggagggcggactcatcagtccagtgggttgtccaggagggagtgagggttgatctttcatctcgaaggatgaatatacatttctgcgagagagggggaagacgggcgttccaggcaaacaagcgtgtatatataactgaagcgtggacagaggaagcagcgtggctggtctgggaatggaattgtttgatctggcttgatggaggagctagggggtgaggtagaagaggtggcagaggccagcttgacctgtgtagatggcttgggagaagccctggcaggtctttgttggagggctgacaggaagggatatgtgctttccatagttgaccttggagggtgcggcatggggtggaggcccgtgcaccagaggctcctcatagagtctctacagagagatgaccaggctagcgttttcatggcatgaaggttgtcttcagaaactcgcttcacaatctacttaagatgagtcaaatctaccctccaaagaacatctgctgctactggagatagcgcttcaaaagctaatgcaggtgctgaatgtttttccaccatgagggttccttctgtgcatcaattagtctagactcttgctgtttgaggaaagaggctcagagtagttaagccactagctccaggtctcatagctggctgataggacatcaacctgcggagtctctatggaggtggaatagtttcagtggtgcactgaaacagtaggggatggataggagaaaggcttggtctattagtcaggttgagccagagaagcagtaagggatggatatgaggagatacattgtgaggaatctgcacacgtggttttgggacctggccaggcaagcctgaagcccgcagggcaggccatggggaagggcaggctggaactcccaggcatggctgcagctgcagtccacaggcagaatttcttcttcctgaaggaagccttggctctacttttaaggtctcctgacaaattgatccagacccagacagattgtctgggatgatctcctttctaaaagtcaactcattatggactttaatgacatggacagaagactttcacagcaacgtctggaagagtggctgattgcctagccaagtcagtacctcaaaaagaccacactcttgataacacgtgggggctccaggaccaaaagctggtgctgcagatgtgtggggtggcagcattgtcacttcctgtctcccactaacctcagggtcacagtgggctggtggctgtagcatgctccacacctgctctcagggatgctggagggagactgaggcccaggcttttgtcttagagacttgggatatgtctaggatcccttctaaaagccaagttctagatagaatctggcctttcagggttggagagaccccatgtggcttctgagcagacttccttcctgatctcagtcttggaagtgaaggtcttacccctggttgcccccttcctgtgacagagggctctttgcctctttgcactccatgccccagagacaatcagtgctggggacaattttgtcagaaatctattcccagccctagcttagcctagtggcactctcagtcctgaaagctagaggccatttccacattggtgtagcaccgtggttctcagactgtgtttgctatcaggatcacctggggaacttggtaaaaatacaaatgcaggtcatattctgcttcctccatcctgggcctctgtgttctttattagccttcttggtggttctgacctacatcaaagttgaggaccactggcataacgcacggctgctcgaactccagtgtgcgccggaatctcctggggatctcatttattttatttttattttttgagacggagaatcactcttgttgcccaggctggagtgcagtggcacgatctctgctcaccgtaccctccgcctcctgggttcaagcaattctcctgcctcagcctcccgagtagctgggattataggcacatgccaccacgcctgactaatttttgtatttttagtagagatggcgtttctccatgttggccaggctggtctcaaactcctgatctcaggtgatccacccgccttgggctctcaaagtgctggggttacaggcgtgagccatcacgcccggccagggaccttgtttaaatgcagattctgattccatggtttttggtggatcctgcgattttgtgtttctaacaaccccccaggtggtgcagttgcttctggtcctcaggccacatcttaaatagcaaaggcgtagataggggccgaaattaagcacttaagaattacccagacttgcatcggaattctgcctctaccacttaactgtctctgtgttaccctgagcagactgcttgatctctctaagccttgatttccttatctggacaatgggaataatgtgcctttttttttgtttttttgaggtagcacctctgtctgttgcctagcgtggagtgcagtgctgcaatctcagctcactgcagcctcaacctcctgggctcaagcggtcctcccaccttggtctcccgagtagctgggacctcaggcacacaccaccacacccagctaatttttaaatttttaattagagacagggtctcattgtgttgcccagactggtcttaaactcctgagctcgggcagtcctccctccttggcctccgaaagtgctgggattacaggcgtgagtcactgctcttgctgctttttaaataaaaactgctggccgggtgcagtggctcacgccagcaaattccagtgctttgggaggccaaggcaggtggatcacttgaggtcaggagttcaagaccatcctggccaacatggtgcaaccccatctctactaaaaatacaaaaattgcctgtcgtggtggcagacccctgtaatcccagctactcaggaggctgaggcaggagaatcacttaaacccaggaggcagaggttgcagtgagccgagatcatgccactgcactccaacctgggcaacagagcgagactctgtctcaaaataaataaataaataaataaataaatattgctttgacagttagaaaagaaagagtttaataccgcaacataataaagaccatacaggcaaagccaccagccaacagcatacccagtggtgaaaaattgcaaaggcttttcctcttaagatcagaaacaagacaaggatgccccctttcaccacttctatttaacatagtactagaaattctagccagaacaatttggcaagaaaaagaaatcagaggcatccaaattggaaaggaagaggtgaaattttctctcttttcacatgtcatggtcttatgcaatatgtagaaggccttaaagacttcacacgaaacacacaaagctgttataactaatacatgaattcagtaaagttgcaggatccaaaatcaacacacaaatatcagttgcatttctatacactaacagtgagcaatctggaaggggagttaagaaaaaaattccattaaccaaggaagcaaaaaaattgtacacagaaaactaccgaacattgctgagagaaattaaagaagacaccagtaaatggaaagacatggaatgtttttagattagaagacaatattgttaagatgtcaatactacctatattagtccattctcatgctgctaatacagacatactcgagactgggtaatttacaaaggaaagaggtttaatggactcacagttccacatggctggggaggcctgacaatcatggttgaagatgaaggaagagcaaagtcatgttttacatggcagcaggcaagagagcttgtgcaggggaactctcatttataaaaccatcagatctcatgagatttattcactaccacaagaacagtgtgggggaaccacccccatgatacagttatcgctacctggccccacccttgacgtgaggattattgcagttgagggcaagatttggcgtgggacatagccaaactatgtcatatccaaagcaatctacagattcattgcaatccctatcaaaatcccaatgatgctttttgtagaaataggaaaattcgtcctaaaattcttgtgcaatctcaagggaccctgaatagtaatagcaatcttaaaaagaaggacaaagttggcgatctcacacttcctaatttcaaaactagctacaaagctgtagtcatcaaaacaatgtagtagttgcataaagacagacatacagacgaaaggaattgagtagacagcccccaagtaaaccctgacatatatgggcaaatgattttttgacaaggatttcaaggtcattcagtggggaaaggatagtttcttcaaatggtgttggaaaaactgaaaacaatataaaaacaacacaagagaatacaaaaatcaactcaaaatagatcaaagacctgaacataagagctgagaccataaaactcagaagaaaacaggtgcacaacttcatgacattggatttggtagtgacttcttggatgtgacaccaaaggcacaggcagcaacaggaaaagataggtaagttggacttcatctaatataaaaacttcctcaaaggacacagtcagcagtgaaaaggcaacccaaggaatggacggaaatctttgtaattcatacatctgataaagggttaatagccagaatgtgtgaagaattcttagaatttaacataaaaagaagccacctgattaacaaacgaacaaagggcttgaataaacatttctccacagaagatagacacatggccagtaaacacagaaaaacatgctcagcatcacaaatcgttagagaattgcaagtcgaaatcacaagataccacctcatatctattaggccggctattacaaaacaaaacaaaacagaaaataagtgtctgtgaggatgtggcagaattggaacccttgtgcactttaggtgggaatgtaaatggtgcagcccgtcggaaaacagtatgacagttcctcaaaaaattgaaaatagaattgccgtggaatctaggcgtggtttcacttctgggcatatgcccaagggaagtaaaagcaggggctcaaggaaatatctgtacattcatgttcatgcagcatgattcacaatagtcaaggggtggaagcaacccaggagtccattggcagatgaatggatcaacaaaatgtggtgtatacatagaatggaatattattttgccttgaaaaggaaggaaattctgacacatgctataacatggatgaaccttgaaccttgaggtcattatgctaaatgaaggaagccagatagaatagcacagatcctgtgtggttccactgacatgaggtactcagaatagtcaaattcatggagacagaaagtagaatggtggttgccaggggctagaaggagagggaagggggttagtgtttaattaggacagaggttcagttttacaaagtgaaaagagttctggagatggatggtcatgatggtagcacagcagtgtgaatgtacttagtgtcactaagctgtattcttaaaaaggcttccaatggtaaatttatgttacgtgtattttaccacaatttttttttcttacaacggaaaggactcaacaccatatctagtaaaacacacactgaatgttgttattgaaagcatagatggcaggatcacttgagtccaggagttcgagaccagcctgggcaacactgggagactcccatctctacatagaattaaaataacagattagctaggtgtcctagctactcaggaggctgaagtgggagggtcctttgagcctggaagttcgaggctgcagtgagctgtgatcatatcactgcattccagcctaggtaacagagcgagatcccatctcagaacaacaacaaaaaacaaataaaaaaataaaagcacagagccagtcacagggacactccatacatatgaattctacccacagtcattcgtgcccctgagtgtctgccttcccaccattctctgggagttggtttccattccctcacctctcctgttctctctgacaaaggtaattgaaactatgtttctgttctttcagtatggccaggtgggaagctgttctctagtgtgagttaaccaggacagagggtgtgtatgtgcaggggagagaagccggcaggctcttcctcccagatgctggactatggaatgtgatactaacatggggatcctccccaagagccttggatcccctagtgcaccaaagtatcctactgagaaggcatcagaaaatctgactcacagaagttagggcagtgtttacagtaccatgacagcaggcagagcttggggttcaaagcagaatctgaggaaagactctaaaaagacgagcccctgcccaagatatggtgccttttctagtctcatagcacattgcaccccctcccctcactgtaacaatccacaccctcagaacgcgcacctggagttgttcatggagactaaagtgggaggaagctttggacagtcacctttttgaagtctgttttgaattgaacagtgtgcaaatgataagccacttattttaaaataagcttcttaattcaagtgtaatataaacagaaaagtacaaaaatcctaagtgtttattaccatgaatattttcaaagtgaacacatccatgaaactaccatccagactaggaaacaaaacatcaccacaacccaagaatctcccctagggtcctctcccagccataacccacccccgaccactaccaccaccacctaaaggtaatcagaatcctagcaccaaatgttatttttgcaaatgtttgaatttttttttaaataaatgaatttctacaatatatactgttttatgtcagcttattttatgcaacattatgtttgtgagagtcactcacaggtggtgtgacagtagttcattgactcactgttacagagcattgtaaaaatacaaataattcatccattctatgtttgatggacatttgcatcttttctagttttgggtcatgattgctgctgggaacactgttacacatttgttgtacacatgattgcatttctattgagggtacatccaggattggaatgggtaggtcacagggtctgggtatgtttctattttagtgaacactgccagtcctttttctgacgtgattgtacccaattacactcccacctgcaaataggagtttcatttgctccacatccttgctcataactggtggtgttagtcattttaatttgatttttagtggatgcatggtgggatcctctggtatgattttcagttcactgaagactgttgaatatctctttcgaatacttgtcttgtgcttttcgaaaccttctcttgaagtttttgtgcaagtttttgctcatttttctgttgcattttctttcttagtgctttgtaggagttctttttttgttttatgagatggagtctcgctctgtcgcccaggcttgagtgcagtggtgcgatctcagctcactgtaagcttcgcctcgtgggttcacgcccttctcctgcctcagcctcccaagtaggtaggactacaggcgcccgccaccagcccggctaattttttgtattttttagtagagacggggtttcaccgtgttagccaggatagtctcgatctcctgacctcgtgatccgcccaactcggcctcccaaagtgctgggattacaggtgcgagccaccacacccggccgggagttctttatatagttagtacctgagacctttgctagatgtacatattacaaatattttctcacactttctcacgttcagtggtatcttttgatgagaaggcccagattatcaatcttttcctttaaggttaatgctttttgtgccctgtttaggaaatctatgcatacctaagaacatgaaaacaacagcatatttattttttccagccattcttgttttctaatatatgattttagggttataaatagcctattaagcctgctttagctgtaatccactatttttaaaaattgtagtaaaaaaacacagcataaaatttaccatcttaaccatttttaagtgtacagttcggtagtgttaagtaaattcataatgttgtgaagcagatctctagaactttttcatcttgcgaatctgaacatctatacccattaaacagcaacttctcattctccttgccccagcctctgggagccaccattctactttccgactactctaggtacctcaagtggaatcctacagtttctgtctttttgtgactggcttattttgcttagtacagtgtcctcaaggttcatctgtgctgggttgtgtgataagattttctccctttttaaggctgaataatattatgtggtatgaatagaccacattttgtttatccatcatccatcgatagacattgggttgcttttattccttggccatgatgaatagtgctgctgtgaacatggctggctgtccagcaccatttttggatacgttgtatttttattattaattagttcaaaatctgttcactttttaaaatttctcctttgaaatgtgggttattttaaagtagttgatttccaaatgcctccatattttctggttatatttttgttatttatttctagcttgcttaccccgtagtcaggaacagattatttacaatgttaacattttgaaatttgtttacactggctttagacttgtccaccatatgattaattttgacagactatcccatgtgcccttgtgtgtagttcctcagttcagtactttcgatatattcatgaggaaaaatgggtaattgtggtgttcaaatcttatatttccattcttatttttacttctttgttatatcatttactgaaagaagtgtgttaaattatccagctgctcataatgtctgtgtctaatagacataaatttcataatgtctaatactttagatttgtcttattatagtcctgtcaattctccctttataaattttgagtgcatttaactagatacatataaatttagaatttattcctagtaggttgccctttttaattatgaattctttcttttccataagaatgctgcttttcgtaaaatctagtttgtctaattaccaatataggtatataaactttcttttttaacttactgctttagaatagttttagattcacagagatgttgcgaagatagtagagagttcccatacatcctgtacctacttttccctgttgttaacatctcacattagtatggtacatttgttacaattaatgaaccagtgccaatgcattattattaactgaagtccatacttcattcacattttcttagtttttatcaaatgtccttttgctgttccaggattctattaggagactgctttgagttcagttattatgtcgctttaggttcttttagactgtgacagttcctctgactttccttgtttctgatgaccttgacaattttgaagagtagtggtcaggtattctatagaatatctttaaatttgagtgtgcttggcatttttctcatggttcaataggggctatgggctttggggcagaagatcccatctgaaaaagtgccattcttatcctatcaaatcagggctacataatttatcactgctgatgttaccctcaatcgtctgagtgttatgcaccatctccatgagggaacagtatctacacaaattatttgcaattctgcacagggagattggtctgttctcactcatttattttctcattcatttatttatatttgtatggactcatggatattcattgtatactttgggctataaaccagtattgcattattaattttgttgttcagatagttccagcttttgccctttcctaagatagtggactcacccctctgtgtttcaactctaccaatttggaccctcaagttcttgttgccttattagccataaattgcaatttcttatttccccagtcctctgagactactgaaagttctgcttaggcctattgcctcttaaccactactttcttcctgtgtgtgtttttaaccttttggcttccatcactcacaaatccccaaatgccttgacgagaaaagcagcacagaatgctgagcttatttctgggtaattatctacttgtcatgatctcagcccctcaagtcctagctgccttggactctctgatgcttccacagagatcatttaaaaaaatttcgtcaagagtttctagttgttcttggtgagaggattagtctgacacaagctagtgcatcatagcaggcggtggaattcttcagacataatatttttttttacttcttctactatgtcatagttgatggtgcctcatggtattttaatatctgatgctttgcacccatacagcaactatcctgagtaacgaagatgttatgtcatataggaaaatgagtcattcttttttttttttttttttttttttgagacagagtcttgctctttcgcccaggccggactgcagtggcatgatctcggcttgctgcgagctccgcctcacgggttcacgccattctcctgcctcagcctcccaagtagctgggactacaggcgcccgccaccgcgcctggccaattttttgtattttttaagtagagacggggtttcaccgtgttagccaagatggtcttgatgtcctgacctcgtgatccacccacctcggcctcccaaagtgctgggattacaggcgtgagccaccgcccccggccgaaaatgagtcattctttgcatttcattcatttatgcccttagtcacaagggctttagcaaagaattggcttccaccctctctttaaggtaaggaaataaataatgaccttggaagacagtattcatcataaaagcgcttgatgaaaggagcaattggagtgaactatgtaaaacaggcttttcagtctaatgggacagtgtaattactggtgcagatttctagttaggccttaaagaaattaagcctccctatatggttaataatggacttgtgtaagaagattgcttcagagatgaagtttgtgattcacattagcatatttggcagtgaaagcgttacctttctcaatcaagcaggatatgtaagatctttgtgtatgcttttgctaaactttactgctgccatccctgaacttgacttgatatttttacatccccttcaagtctgcatcccagttttgtgtcatctacagttctgaagagctgccttgtgctttatcatcatccagggttgaaaagagccagatcattggagaatccccacagactgacagttttccctgaatcgatgcctgcttattgtgctcatgcaggtagctcctattccatctcacttcgctgcatgcagctcacatatttcagatgatccacaagaacattgggaaggacctgccaaaatcctgccttgctaaagtccaggtatactctcttccagatctcccttaactgcctttgcagattctatatcggagaaagaagtgaggctaatttcacaaacttattcttaccgaattcatttatagctctaataattaccacttttcttagatgtgatcccaaaacaatcctttaataaatgcattttagaactgcactgtccatagtggcagctacttgccatttaaatttaatttaaatgaattaaaatgaagcagacaaaaaatgcagtttctctattggactaaccatgtttcaagtgttcaatacctgccatattgggcagtgcagatagaacacttctatcattgcagaaatttctgttgaacagagctgttctaaaaccttgttttagaatcagatctgagctcacccgtctgcagattactcagtcatcatttgactgtttttttttttttttttttaaagagacagggtctcactttgttatccaggctggagtgcagtggtgccatcatagctcactgcagccttggactcctgagctcaagtgatcctcctgcctgtctcctgagtagctgggcctacaggtacatggcaccaggcctggacattatttaagtctttaagaaacatctacatgtgttttttcctgtcacctctctttttctccatttccttcaaaatcaccttgaaggcgactccatttctgtattgcccaaatcagtctacagtgtaggtgttggatgtggactttttttttggtttctaatgaggttgtgttgcagatgagctgaagccacctttgatattctaggatttgtgcctgaagaatagcgctttctgtcttgctgatgtttatatgactgctatgattgtcaagggaaataaggagaaatgaatgggatccacgttgcttggcccagcatacctgtttctgagtgctgttggagctgagaggcatgctcttggagaatcagccatcaagctgtcttttccagagtggatgttgtccagggcagttgcagagtgagcacactgtcaatgagtgcctggggtccttcatttatttctttacagcatctgtagtagaataaaattccagtgttaagagacaaaaaaaatgtgcccagctctcctggggttgacagtctcagttggtaaatcccatcccaagggggcagctcctctcctgtctgtggtttgcctgctgtcccccaggagccacactcaccagtttggtcagctggcagatgataagagggagagaatcttttagaaaacagatcctggagatcattgttagtggagaacttattatcaagtcaggaagaagaaaaatcattgttagttgagtgaatacattttaaaaaatgataaagtgttcgtcaggcacttgggatttcttgctcatatgctaataggatttttgaaaatccactcactgtttggaaacttgcttgctcagtgacaactgcatccaaatagcagatcatgagccaggtttgtggggggacaagagtgaagggagttcggaggaagtcgctctgggccaggaggcagggaccctggccaccagccatgtgacccggggcagatccttgcagtgctgggccttggttttggccactgccccctggccccccacttcccagaattattgtgaggaactgtgcgtgtatgtgcaggaactgggttaacatatctacttatggttggccgggcgcggtggctcacgcttgtaatcccagcactttgggaggccaaggcgggcggatcacaaggtcaagagatcgagaccatcctggccaacatggtgaaaccctgtctctactacaaacacaaaaattagctgggcattgtggcgcatgcctgtgatcccagctacttgggaggctgagacaggagaatcacatgaaccagggagtcgaaggttgcagtgagctgatatggcgccactgcactccagcctggagacagagtgagactcagtctcaaaaaacaaacaaacaagcagacaaacaaacatatctacctctggtcaacacagaaacaaggtaagcttttgttatcccctttgatagacaaagcaacagagcttaatgagcatgcatgtcacaaggaagcacaaattcacgcttattatttttatgggaagacccctcacttcctggtcctgatgttctctgtgggacctttggtgagtcagggaaggcctcacagtatggagacaacagtcccagcctctgacttgcaggagtgtggggactaagtgacactggaagtgtgctgcacacgtgcaggcctggattattaggagggaaggttagaaatcaagagccaggggaaaactgggaatagctggctggcttttcagaagggagtcattattttgtgcaccttgcaactcaggcagtgagcctggcggggaaagagaaatggctgctctttttttctgtccatgtgtcaccccctgtcagtgtgttactgggtgcaggtgtctcctctgatggtgtctgggcttttctttcccctcccttccttctttgcctgcttctcctttgctcctctgtctccgtttctctctccctgcattttgtctctttctattccttctttcttccttttttatcttcagattttaacctgttcctttcatcaaatgatgcttattaaatacatttggtgatttatatttttgtttctaagaaagctgatcaaaataactgtgtaagttcagtccgtgaaaagacaataatgatgacaggcaggcagcgctttggaggaaggagggttgggtcccgggtacccctgattcggtgggtgtttgtgcatagagtggtacctgcctgcttgaggataggaggctttgcagcttgaggtccttgctccctggtgtggggcatctgaagggctgtggtgggaagagggtcagaaccaaggccagatgcacccggagcttgctgcacgcacttctgggaggtttcctcttattttctctattttaatttctccattttctcttttctctctttcctctctttctggaattcccatctatctgatttttgacctattcattctatctttgaagtctctcttttctttcatatttttccatcttcttttctttctttctttttttttttttttttttttgagatggaatctctctctgttgcccactgcaacctccacctcctaggttcaagcaattctcctgcctcagcgtccagagtagctgggattacaggagcccgccactgcgcccggctaatttttgtgtttttagtagagacagcaatttcaccatgttggccaggctggtcttgaactcctgacctcaagtgatccgtccaccctggcctcccaaagtgctgggattacaggcatgcgccaatgtgcccggcaccatcttcttttctttccgttctgttttctgggatagttcaacgactttaaatacccatattgaaatgtttatgcttgctcttactttggctctctgagggctctttctattctttcgtcatttcttattttgtagcactgtatctttgtgtttctgcggcaatatcttcttctatttatttaaaggtattaatttgttattttgtttcttttttgacaattacttctgtttccttcactatcttttttcctttgctgtccttgtacttgcttgcctggattttcttcttcctgtttgagaccttcctcccagatctgtgagccgtggttgttaattcgcattgagaagtgaagcactgaaaattgactggagtgtctgcaacgtggctgcacattagcatcacctggaagcattaaaaactacctctcccgggggacagtctcagggccattggatgaagatctgttagattggggtctgcatattgataggttgataaataaagatattgatagagatcggtaggtagaaatacagattttccctcctcagcaattctaatgtgcaagcagggctgagcgttgtatagtcttgggtgacagtgccgggcctctggagagttggtataattaccgtgcagcgaaaccactctgcgttttactgtgccgggtgcctggaagactttgattgcatccatatgattctttttctgtacctctggcaaattgcagattgggaggaattatatatccctacagagacttcagtgaatgaagtttcagggacctatgagcaagaaggatgaactggcttcccggggaggggccagcagtccttctgccagacaagtcatcagggctgggacaggaagcatgggaagggcagctgtgcagagcaggatccaggaggggccacctggtggcaggtgtggccactgagcagcccctggctagggatggagctggagctgccagggaagctttgaggccaggtaacttggctcttgggctctcatgaagccaactgttcctctcccaagctctgagaaaacagtggagtcctggagtgacaggatatggtagctccataaggaggaggaacctgtagttggaggggcaacaccaggaggccagtgagcgatactctgtacctgagagaggtggccggaacctgggcccccacttgctgccagtgaccttgcacctgccacaccttctcttggagttttggcttctttaactgggacatgaggatcctgaccatctctgccaagcaggagaggaaatgggctgatgtgtgttgtgaggcagtagagactggggcataggaagcaaattgactctcagagtttatggtataaccttctcccacgctgtagggatcaggtttgcccctaaacctgcagactggctaaggccagggctggaaagggaaaaaagtaagcagaggacaggtcatgctgcaggccggcccctcacccctggtgacttgtgctcttggagtgagggcccaggagggggttgcctgcctatgcgtgtctctccctttccccctcctgttctgtggggctgggcctcacacggccattcttcgaaggaggaaggtggccttttgcattccctgttggtgtgttacttattgtcacttatttttgattaaggatattatatttagggagaaattatttgcattttctttgtaaatcatctgaagaattgtgcaacacaggagtgcattcgggaagaaaattcagacatcagagataaagcagagttctcccttggctgcatctacaaccttcctctccctagagaaccactctgtggttagtgtgttttccttcattatcttatataagcatttatgcatgtgtagatgtagatggctgtgttttgtttttatgcacatagaaggtatctgtgcattgttctgctgccggagttgttcagaacatggtattgtggagaaccacatgactgtacacacaggtctatcttagagacctgcctcatttgctttaactgctgcagaggcttccagggaccgtgtgtacagtactagatactgtttaatgaacactttcctactgatgaacatttaggttgtttcctaatgtttgctgtcacaaacagtgatgctggtgggttaatgcttctctaggggagagagcaagaagcagaagtgctggctgtcatctgcattctgcagtttaccagatactgtcaggttcccttcccaaatggctacagagtggtttggtccctgcagtgtcatcagttcccgacattataactttgcagatgtgatagggagaaaatctccattttattttttcatttcctggattatttgtgaagtcaagtatatttgcctgtgtttactggcacatgtattttctctttggtcaatttcccttttgtaatttttgctcagtttcccatggggttattcgtctttttcttattgatatctaggaaggtcacacgttcatgtgagtgtttgggtgtgtgggtatacaagcaaaaaaaggtttaatacatcctggatgctcattctttgatacatttacttcgactattttcttccagtctgttgtcttctgttttaggtgttttttttttttctcatccaggtttaaacattgtttattgttgtagctaaataattcactttatttagggattataagaaaatgtagaaagtaaatttgcattcttttcctttttcttagtattatgaaacttatttcttttttaaaaaaccagtctgttgaggtaagattgccatataaaagctgtacacattttttttttccagtgacttttttaaaaaatatatttaaaaacaaaaccggccgggtgctgtggctcacgcccgtaatcccagcactttgagaggccgagaggggtggatcacctgaggtcaggagtttgagaccagcctgaccaacatggtgaaacccggtctctactaaaaatacaaaaaaaaattagctgggtgtggtggcatgtacctgtaatcccagctactcgggaggctggggcaggagaattgcttgaacccgggaggcagaggttgcaatgagctgagatcatgccattgcactccagcctgggcaacaagagtgagactccatctcaaaaaacaaaagacaaaacgacctcctcccaaataacccccaaacaaacaaaaaaccagattaaataaaatttacagtgaatatacccagcaaacatttgtatgtgcaattcaatactgtgtctgttactgcggcacgaacctcagacaatatataagcgttctggggggtcgggagagtcccaagttttaactctgtggggtctaggaagacaagatggggaagtgagagaatggggaaatccgttttgtttatcttaattctttccatataaatatattcataaagaccaaaaaggaaaggaagcttgggatgttaaggtaataggagaataggagagtgtgggactttcccaattctgactgaccaaaaaatatgaaaggaattaattttatggtgggagaagagatttaaaaaataaaaaaaagaggatgggggccaggcacagtggctcatgcctgtaatcccagcactttgggaagccaaggcgggcggatcacctgaggtcaggagttgagaccagcctggccaacatggtgaaaccccgtctctactaaaaatacaaaaattagctgggcatggtggcgcgcgcctgtagtgccagctactcgggaggctgaggcaggagaatcacttgaacccaggagccacaggttgcagtgagccaagatcatgccactgcactccaaaaagctgtacatatttaatgtacaactttgtgagtttagagcgaagccaacccccatgaaaccattgccacagcgtgtgccgtaaacagatccatcacctgctcacgtttcctcctgcctactttattacgatgatgatgatttgtgatgagaaactcaacagaagatccaccttctcagcagatttttaactgtacaatacagtgttgttagctgtaggcactgtgctttatagtaaatctccagaacttactcagctcggacagctgataccgtgtaccctcggcccagcatctttccacttcccctacccccagctcctggaaacccccattctactctctgcttctatgagttgactttttaagattctgaatataagtgagatcatgcggtatttatctttctgtgcctggcctatttcacttaatgtcctccagtttcatccgtgtggctgtacatggcaggatttccttctttttaaaagccgaataacactccattgtaagtgtataccatgttttctttatctgttcatccctcaaaggacatttagattattcacatatcttgggtattgtgaataatgccgcagtgagcgtgggagtgcagacttctctctgaaataccgatttcagttcctttggatgtatgcccagcagtaggattgctggatcattcggaagttctatttttaattttttgaggaacctccatactattttccataatagtgataccaatttgtattcctatcaacagtgcacaaggattttcttttctgcacattctcaccaacgcttcttatctttcatccttttgatactagccattcttacaggtaatagtgtgttttgcatttccccgattggtcttttccttgatgattttttattgtcttatttaagaagggcttccttatactgagtatctaacattttagagtcacctattttacaataagtctttagtccccttgaaatttatttttgtgaatagcgtaactcagggatatatatatagcttttaaaaaatgagttgcaaagtttataacccattccccccaccagctgatttgacatgttacctttatcatatggtaaatcattatagatgatgagttgttctggactgtcttctgctggtctatttgtatactctcgtggaataaaaaattctatggttttatatccttcattgttcttctagagtgtttctgcaattgtttcctctgccatctgaattttattattctcattggaggttcttttggaattgcactgactttctaagttgatttggaccaaattaaaatacttaaaattgaaatatttactatattaaaatgcagtattatttgtttttatctgggaatgtagtgtatttttttcttgaaagttttgtacacttttgttatgttctttccctatatgctttatagttttgttgctattgtgtatgaaatattttttattattacattttctatttggttgttgctggtgcttaggagagccattgatttatgtgttaaactcatacctggccaccttgctaaacctttttcttagtcctaataattcgtccgttgattctcttggttttctataaagacaggaatattgtctgaaaaaaatgcctccttcttcccctcttccttctcaaactgtacacctcttgagatgtctctttgtgtttgtacttctaggtagggtaaccagccccagactgaaaggtgacagtgatagcagccttcctaatcttgtccctaaatttacaggggatacttttatggcgtcactataaaatgagatgttttgctgcacttggctgataaatatcctttatcaagttaagggagtttgcttcttggtctaccttttaaggtttattttaaatcaggaatgggttgtcgaatttgatggccattatacctttttccttttttttttttttttttttttttttttttttgagacagagtcttgctctgttgcctaggctggagtgtagtggcgcgatcttggctcactgcaacctctgtctccgaggttcaagcgattctcctgcctcagcctcccgagtaactgtgaatacaggcgtccgcccccatgcttgactaatttttgtatttttagtagagatggagttttgccatgttggccaggctggtcttgaactcctgacctcaagtgatccacctgcctcagcctcccaaagtgctgggattataggcatgagccaccacacttggccccattttatacctttttcatggaagtaaacattttctaattcacaataaaagagaaaaaagtataataaacacaacatatccattgccatatttgcttagatttgttgttagcattttattatatttgctacttctttcctttttgtcgattttttttttttttttgagatacagtctcgctctgttgcccaggctggagtacagtggcatgatctcggctcactgcaacctccacctcccaagttcaagcgattcttctgcctcagcctcctgagtagctgggattacaggtgcatgccaccatgcctggctaatttttgtatttttagtagagacggggtttcaccatgttagccaggctggtctcgaactgctgacctcaagtgacccacccacctcagcctcccaaagtgctagaattataggcacaagccactgtgcccggccttttttgctgaagttttaaaagttgtagccatcattatttggccatataagttcagcgtgcactttaaaaataagcacatcttcctacatttccacgagaccattatcatagtaacagcattcacagtaattcattgataacatttaatacccagtctatggtaaacactctccagttgttaccagaatgtcctctacagctggtttctttaccagggcctggtcactgcggagacagcactgtgggccctgatgtctccactccttctctaactggaatgcaccctcttcctttttgttccattacacctctctattgcagagactcacgtggaccagctgtcctgcatcaaatcccatcttcagcgttcgtctgattgctttctgggctagcatttaacttttctctctagctcttgcgcttcttgtaaatgggaatttcagtccaaaggcttgtgtgtttttgctgtgaaacaacagcagaatctcataggacgagaatttttcttcctgtttgtaggcagggtcagcaaaagggcaggtttgttcaggttgcaggtctgctggggtagctctgcctgacatgtttattctgagacccaaactagagggtaggggctgcatggggctcgtgttgcccatggtgagtcagaggaacacaggaggagcggatggaagcaggagatggcctgaggtatagccttggggcttgcaggtggacggttcccattccactgtcgagtatcaatggagtgggcagtgtgcttgtcccatggaggaggaaggggtatttgctgaatgattaaatccaacccaccaaagcatgtttagattcagactaaaagttcttggcaagaatacttcataagcggtggtgtatgcattctattgcagcatgtcacaattcacatgtaatacgtggttgtctcattagcaactgatctgactagttaccatttattaataagatgctgtgctgaacttctgttaacctcaaaaggggaaagcaccaggttcaaggctgaagaagagacccagagccaggaaacaagaattgggattttttttttttttttttttgagatggaatcttgttctgtcgcccaggctggcatgcagtggcgccatcttagctcactgcagtctccgccacctgggttcaagcaattttcctgtctcagcctcctgagcagctgggactacaggcacgtgccaccctgcccagctaatttttttgtaatttttagtagagacaggttttcaccgtgttagccaggatggtctcgattcgatctcttgaccttgtgatccgcctgcctcggcctcccagagtgctgggattacaggcgtgaggcactgcgcctggccaagacttgggattttattaggggcctgcatacaggggagacggatggtggtggattggaccagagaaccgccttatgtacagagatggtccagtgatgggctgggcgtggtggctcacgcctataatcccagcaatttgcgaggccgaggcgggcagatcacctgaggtcaggagttcgaggccaggctggccaccgtggtgaaaccccatctctgcaaaaatacaaaaattagccaggcgtggtggtgggtgcctgtaatcccagctactcgggaggctgaggcaggagaattgcttgaacccgggaggcagaggttgcagtgagccaagatcgtgccactgcactccagcctgggcgacagagcaagactccgactcaaaaaaaaaaaaaaagaaaagaaatggcccagagatggcgggctggataacatatcggccttcctgcagtcttgtggcagtgggctgggcaggaaagctgcaacttcttgccaactttatgcagtttatttagcatttctacttaacaccctcctcttaatgacccctacccagcaaccttcatttaccccaaaactcagggcctcaatgccctgtatggcccgtgttccataggatgttccaggggctcaaatgttcctcatagacaaggaacgaatctctgggttggccacacctgattccccagctcagagcacacactcaggtgcatctgccatacagggtccttctgagggtaggttcaagttatcgctgtcaggtgcatttaccctacagctggtgacagcttgagtcttcttttataaagtttcttatgcttgagactgacaagaaatctgtggctagttctttggcaccatgtatatgaacggccagttaaccctctgttatccattggtgatcctggcctgaatcagttaattcattagttgttgcaaattggtggtttcacaattctctcatactgttttcatttattagctgttattcttctgtaaagaagagattttccttatcacctggagctgttagaccaccctgaaatacagtatcgttagaacaggccgggcatggtggctcacgcctgtaatcccagcactttgggaggctgaggtgagcggatcacgaggtcaggagatcaagaccatcctatctaacaaggtgaaaccccgtctctactgaaaatacagaaaaaaaaaaaattagctgggcatggtgttgggcgcccatactcccagctactcatgaggctgaggcaggagaatggtgtgaagccaggaggcggagcttgcagtgagccgagatcctgccactgcactccagcctgggcgacagagcaagactctgtctcaaaaaaacaagaacaaaaaaaaccaaatccttatttctcttcaattgttaattttcagaataagaagttggcaatagccaattttaatggtatgatacattctcagggtgtgccatcttcccctttatgatataaaccatttttggtcatgacgtgttagtttttaatgctaatagtgaacctatttgttaaagtttgaggtaagatctttgcctctctcatgttggagactagtttgtgcttatcctttcataaaataaattgcttcagctttccatctcttttttgagatgtgacatcatggtaatctattccttgaaaatgtaataaaacgtgtttgtcaattcatctcggtctggcctttattaggttaccttgttattttaaaatatcttctatagctattcagtttttctacttattgagccaattgtggtaatttatattttcttagaaaatcttacatttcattcagttagatttgcaaattcattggcataaagttctgaaaagtattctcataattttataaatttttctgcatctgtaattatgggcttttcagttctaatgtttgtgttttctttctttttcttgatttgtcttatgatatgtattctttttatactgggccaactttcaattaattactgtcttaattttttttagtcttttatcttttttttctttttttttctttttgaggcagtcttgctctgttgcccaggctggagtgcagtggtgtgatctcagctcactgcagcctccgcctcccgggttcccgcattctcctgcctcagcccaccgagtagctgggactacaggcgcctgccaccacgcctggctaattttttgtatttttcgtagagatggggtttcaccgtgttagccaggatggtctcgatctcctgacctcatgatccgcccaccttgaagcctcccaaagtgctgggattacaggcgtgagccaccgtgcccggcctagtcttatatttttctaattccttcattttgattttcacttttatttcttagacttattttatacattaacactcttttcgtttttttttttaatttaatttttaagttttggggtacatgtgcaggatgtgcagcaggtttgttaggccggtaaacgtgtgccatggtggtttgctgcacctatcaacccatcaccgaggtattaagccccacatgcataagctgtttttcctaatgttctccctcccccgatcccacccctgacaggccccagtgtttgttgttcccctccctgtgtccatgttttctcagtgttcagctcccacttataagtgagaacatgtgatgtttggttttctgttcctttgtcagtttgctgaggataatggcttccagttccatccatgtttctgcaaaggatatgatgtcattcctttgtatggctgcatagtattccatggtatgtatatatgtaccacagtttctttatccagtctttcattgatgggcatttgggttgattccatgtctttgctattgtgaatagtgctgcagtgaacataggggtgcatgtatctttgtaacagaatgatttattttcctttgagcctataaaccagtaatgggatcactgggtcaaatggtatttctggttatagatctttgaggagtcaccacactgtcttccacagtggttgaactaacttgcattcccaccaacagtatacaagcattcctatttccccgaaacctcgccagcatttgttgtttcttgactttttaataatcaccatcctgactggcatgaggtggtatctcattgtggttttgatttgcatttctctaatgatcagtgatgttgagctttttttcatatgtttgatggccacataaatctcttcttttgagaagtgtctgttcatgttctttgcctgctttttaatggggttgtttgggttttttttcttgtaaatttaagttccttgtagattcttgatactagacctttgccaggtggctagattgcaaaaattttctcccactctgtgggttgcctgtttgctgtgatgatagtttcttttgctgtgcagaagctctttagtttaattagttcccatttgtcaatttttgcttttgatgcagttgcttttggcgatttcataatgaaatctttgctggtgcctatgtcctgaatggtattgtctagattttcttctagggtttttatagttttgggttttacatttaagtctttaatccatcttgagttaatttttgtatgaggtgtaaggaaggggtccagtttcaattttttgcatatagctagccacttcttccagcaccacttacaaacagggaatcctttccccattgcttgtttttgtcaggtctgttgaagatcagatgacattaacccacttttctaccaaaaaaaaaaaacccctctgtagtaaatgtgtatatttcctaatgagtactaatttggccatatcccctagttgtgatatctaattttttgttcatgtctaaaaatacatcatttacattttgaatgctttctaagcctcagttatttaatgtttaagaatttcccaggcatgtcatattttgttttgtttttgttctttaactatctttgtagcagtctgggtccactcaggagatgggaaccccagggggagcatcatatttaatagaattattaggtatgatgagagagtagctgttaagaggtggaagttctgtgtggtatcgtgggggtggagggagggggacctaagcaggggcagacctgggaaagccccagggaaggaccagcttgttagggaaggtgtggttcagcagtggagagcagggacagccgctggttcaggcagtccagcactggtctagagatgctgttggtcacaataggccaccctctggagtacaggctggggagcagtggcttgaggctgggcctgcggtgtgagttcgggcaccagcacgtccagaggtgccggacatgcagaaggaacgattgctcaacgcaggactctccagaccacgcgggctacatggggtttgtcgagggagtccagaggtggctggccatgtggagctctgggttcgaggcccaacaggtgtggccccaacaaggctgcagggttgcagaagaactaggtgcctctgtggcctgagccgggaactgcgggaaccgttttcctccagcaatgttgctccatcaccctctgcccagaaagcttaatgtgctcactctaaaggagaaacatgaccgggcccggtggctcacgcctgtaatcccagcactttggaaggcagaggcaggcggatcacgaaatcgggggatagagatcatcctggctaacatggtgaaaccccgtctctactaaaaatacttaaaaaaattagccgggcgtgatggcgggtgcctatagtcccagctactcgggaggctgaggcaggagaatggcgtgaacccgggaggcggagcttgcagtgagccgagatggccccactgcactctagcctgggccacagagccagactccgtctcaaaaaaataaaaataaataaataataataataataataaaataaaggagaaacgcttaagggaattctgtttattcagagaacatattgaggggtacattcagaattgggaggcaatgaattgataactgacacaacctttttgtcattcctttctaattgtcccattgtagtcagtgggtgtagccagtacagattctttgtagaatgtcacatttcttttgtggcctaatgctacataggcagttttggttaaacccatgtgagtatgtgtgtgtgtgtgtgtgtgtgtgtgtgtgtgtgtaaaacctccgccttctctatttgttaggtacggggttctaaataaatcttattgttatttaaatttttatatcccatctcatttttgtctggttaatttgattttaatctctcaatatgaatgtggctattaatttcaccttttatcattatttgcttggtttatattttgaagctatgttgtgaagtttataaaggtacatgatgctcttggtggattatttttgttattaatgggaatttttccttttatgcctttgcatactttgttgtttacattcattttgtctgattaatattgccatatgagccttctttttattagcacttgtctggtgtatcttttcctatacttttatttttagcagtcttcgtgccatttttttcaggtgtcatcagaagagactaagcaactcatggcttaattttctaaaataatctgaaaatctatgtttttcaacagatggactaaaagagagtataaagagcactgcattcatttgctcaggctgcggtaacaaaacacagacttggtgtcggaatccatagaaatgtattgcctcacagttctggaggctgggagtccaagatcaaggtgtcagcagggctggcctcctcgggccgtctctccttggccttgatgcccctgcatgtgttcttccttctgtgcctgttgtgtgcccctggggtctctctgtgtaccccaatttatcttttttttttgagatggagttttgctcttgttgcccaggctggagtgcagtggcgcaatcttggcccactgcaacctctgcctccccggttcaagtgattctctgccttagcctctggcaaaatgcccttttcaatcctccctgccattggctacttttaggatcctgctgattggtgcatgttacagattgctgattggtgtgttttacagagtgctgattggtgcattttacaatcctcttgctagctacagagtgctgattggtgcttttttacagagtgctaattggtgcattttacaatccacttgctagctacagagcgctgatgcattttacaatcctcttgtaagacagaaaagttctccaagtccccactcaacccaggaagttcagctggcttcacctctcacaaccaccccaagaaagttgagggtgaagtgcaggccatgcacaggatgctgtcttgatactgagaaaaggaaggtggtgttaaccacagaatttcatggccaggggtgagagttaatgtagcagaggggctctccttggaagggctgtctagaagaagagtgtgtaactctgggcaggataggaagaggtgacacctccatgagaaaagggactttgtcttttttgcccctgtctccccagcctgtggctggtgtgtgtcaaagaggcagagtcattcctgtgtagtcatgatggttagttttgtgtgttaactttgcccagctctggtgcccagttgatttgctcaaacaccagtctggatgttgctgggaaggtaatttttgggtaagatgaacatagtagaccttgagtaaagcagactgtccttcatatttggatgggcctaattcgatcagttgaaggccttaagaccaaaggctgaggttccccgaaggggaaggtcggcccccagacccccttgtgactcaagactggaatgtcaactcctcctggagttcccagcctgccggcctgccctgcagatttcagatttgccagcctctgcagtcatgtgagccaattccttgaaataaatctctttttatatatcctgttggttctctttctctgaaaattcctaatactgtagttttttcatctggtgatctatttggctatctcactaacttctgagttgggacagcctcagagtcagaagtcatgtgtctcctggaccctccatccccaaagcacagccccatgccaaaatatgcctttatgttagtagcactgcccagccctgttcagttttctgagatccagttcctacaagactgtggcactcagtacttttcatctcattgggttctgtgcctctggggctgttgcctctgagaccagatcccggatcctttctttgtgggctgctccacccctgctgtggaaatcacacagaaggcggacagtacatgtggacaggtcagacagacacactgattggccagctgcagcatggggagcatggactctgcccacagctgtggcgagatggctctgtggtgagatctgggctttcttgtgtgctgaggaatgggagcgtttgccatccttatccaagctgcatcactcagggctggcccctctgaggttgcactgtgggccccaccccagcctctgaacgagaattggcataccagccagatgcctaggtgatctgtgcatgtgctgcaggtggagaaggtctgcactagacatctccagaaggacgatctgggatcagggttagacaaggcccacgtctgctgcccagccctctcctctttgatgtcctttctgcacctgacacctcttcttgacattccctttccttggtttatgtggtaagacctctctgtccacaacaggaatggtcttacccatcttcttctcctaccatgtattaatagttccctgtgccttaaacccctgattcaaaacctgcttcctcaactctccaaagtcagccaagcgagaggttatgggcacagtcttccacaagactgccctcacttctgacaccagccccaaattcaggggtcctcaggcccatccttacttcttaccagctggtcaggggttcccatgaccagtcttaaattagataatttgctagaatgactcacagaactcagaacaccattatacttaacaatgacagtttcattatagcaaaaatttacaacccagaaccagacaaaagaaggaacacctggctgggcgcggtggctcacgcctgtaattccagcactttggaaggccgaggcagctggatcacgaggtcaggagatcgagaccatcctggctaataacggtgaaaccccgtctctactaaaaatatttttaaaaaattagccgagcgtggtggcgggcgcctgtagtcccagctactcgggaagctgaggcaggagaatggcgttaacccaggaggtggagcttgcagtgagctgagatggcaccactgcactccagcctgggcgacagagtgagactccatctcaaaaaaaaaaaaaaaaaaaaaaaaagaagaagggacacctagggtgaagtctgggaggcttccagatgcaaagctttggcgtcctcagagatgcattatcctcccagcatccaagtgtgacagtaatcaaagagtattgccaaaaaaggaacctcacctgagcttcaatgtctagagtttttatttgggattctttatgtaggtatgatgcatgatgaattgaatcagtgaattgattaaattgttggccatgtggttgagctcaatatctagccttcccagaagtcaggctggtagcccgtgtctcctgtctcaaagccccaaccctctagtagctagttggcctctctggcatcaccaacctccatcctgagtcatctcttttgcataaactttggaacgcaccacgaataacaaggacactcctatcacttggagattccaaggatgtagaggctccctccaaggtaccagaaggccagccaagttctttattacacaccaactgattgccatgacttagtggttaataaagagtggggcttggggttcctttagatttcaggcctgacacaaccccttggatatagactacatgaaatgaaagtgttaggaagggtgtatgcatgctatttgtttactttgaagagtgacacttggaaccaatgtcagttttacaggctgccctgacttgctggggcacagactgtgaagtgcatattcagaatgaatgaagtgttaccctacagcagtggctctcagacttgcaggcatcagaatcccctggagatcttttaacatgcagacttcagggtcctgcccctgagttttcattggtctgggggagggcccaagagtttctgtgtttgtggagttcccaggtgacactgatgctgctggcccagggaccacacttcaagaagccctggaatagactctgtggtgggtgtttgaactttggattcttggccataggtttttacattacaatgacagaatgggaagtttggcaggaataaagatgacttccacccacaggctcccggggaggtccttcttccctgggccctggcctggtgtctctgtctagcagctagctagcattcaggtcccaggtctcacattttggctggactttaatggcaattgatgggcaagtgcaggctgttcttgcaggggagggagtgctgcctctgcttgggctgctaggcttggggcctggtcacctggggccactgcccttccttcagtcttgccagacaggcagaggagtaagggcttgctaccggggcagagaacatcgaatgattgcaatcgtggggtcattaggattaattagtaaatagccatcagatcttaaaaaatagattcaggaacagcctgggagggcatttgggtgtggtttcccagtttgaggggaaagcatgaatcgactactatctcaggtagggctctggtgctgggaccctgctcaggccagttaagtgacagtggatgtggcctggaaatcctgtttctctcatgttcagtgagggtggaattaggggtgtgtgtggggaccttgggggcgccatgtgatgattaactgtagtctgtctcagttgtggaagctgctaatgtgtttttctgggacatcatcatgggatttttattattgatttcagcagggagactgctggctcattatgtgacaagaaatcgatgtggtgttccacgttcgaagcaggggttctccgtgacgtgcgggccctggaccagcagcctcagcatcccctgggcatgtgtgagcagtgcacactcccagcctccccctgacctgctgagccagaagctctagggctgggagccagaagccccgcaggtggctctgctgcatgggaaggaactgttgggatgcaaagcaggccagagaggacaggagcagacaaagatctgaagctgaatatggacccctcagggtgccagctgtcaccccggagcgcccccctacctggggaagctttggcaaccttcctggttgcaagccaaggcccagggactccaccgctggtgacccccttacctggccctggctgtgccctttggctcagggctgggcccgggaggctggagaggtgccagggttcattgccagaggctgccttgcccctcccttgtgtccttgtaggcagagccctcacccccctatgctttcccgccacccaccagccacacctccttgcccaggcctcagtgcctgacagatggcctgaatacatatatatatattttttgtcttaaaaaactattttttttaacatatctacagactctccccttaccaggtatttcttggggaagaaaatgttgcttagtagacaaatgtccccaggtctccttcagggaggatgagcatcacctgcattgaggaaggggtgcttcagcagagatgctcacttcaaagcgagcctcactagtagccacagggtgcacagctaggatgggaggcagtgctgctgagccaaggggtggtgggagcagctctggagaaacctggtcgggtggtgggtgaagctgcctccaccccagcaagcgatatggggcctccccactggactggggaactgtgtatgagggtttggggtgcagagacctcaggtggccttcaaaggaggggtggccagaggcccagcaggtgactcccacacctcttttacatcatctcctgctgaacaccccagagttccctgcttcttacagtggtaacatttgtttaggagttgtgcagtaagtagaccaggcatggtggttcatgcctgaaatcccaacattttgggaggctgaggcaggcagattgcttgagtccaagactttgagaccagcccgggcaacatggtgagaccctgtttctataaaaaatacaaaaattagccaggcaaggtggtgtgtacctgtcatctcagctattttggaggctaaggtaggaggattgcttgaacctgggaggtggaggttgcagtgagctgagatcacaccagtccactccagcctggataacagagagagaccctgtctccaaaaaaaaaaagagaaagttttgcataaataaagttaaattatttaaaataaaattatttaaaataaaagttaaattgtttaaaataagctaggagaaacttgctacttaaagacatcttttgggagaatttttattcagaagataatcatttatcaaagtgattgagtaacctgtaatttatccagtggagtttaatttaagcatttgaatttcatgtttacccttttagcagctatcattgaacccgtcttggtagctccaaagcacacttaaatatgagatgcagcccctgcctccattggcttatggactgggtgggtgtgtagccaccgtgtacagaaagttaaagatggttctagggaccaggcaaacagcctggggtgagttaccagaaggatgatgtgaatcatcgtgtgagattacaggttgcccatcaccatggccagtgcctctgagggtttgttgggattagaggggcagcttccaggcctttcaggagaggagggtctttacatgtcttttgtgggtgaggacctgaggcaagcagagagagacagccagagttacgtggggctggaagaaatcaggccagagtgactgggacccttgactctccttgttagagggtgtgtttgtccattttgtcctcttataacgtagtaccacagactgggtaatttataaagaaaagaagtttattggctcaaagttctggaggttgggaagtccaagagcatggtgccagcatctggtgagggcctttgtgctgcctcataacatggtggaaggcatcacatggcaaagagacagagagacaagataggggctaaacttaacctcttatgaggagccctctccctgggtaatggcattaatccattcctgacggcagagtcctcatggcctaatcacctcttcagcatactgtctcttaatactgttataatggcaatcaaatttccacatgagtattggcagggacttctgaaccatagcagagggactgccttccccatggatcctggtgtcctgcaccctgggcccagtccactctctggctggcacctctggttttgccccccaggactctgtaagctctagccaaggcagctggtgctgtgcttgccagctctgtgctttgacaacaacttctgccttccccacactgtctgaactccagggtctcctcttcgttttggtgttgggggactctggctcaccacagagctcctctccaggcacgtccctccacagcacctgggaaatccccttttctggctccaagtgacctatcttccgagggctacttgggaattcacagaacctcagctatggagaagctcagaggattgggggattgaaaccgtaggtcatccttgaatggttagcttttgaaaataattgtgcatttttccgtggtatgggttggtttcctgtcctgtctccacagtgctgaaccaaatcagcaacgctgcactttgcaactctgacagttgagcttcctggtcctgcgattagagccctcaagatagtactgaagcattaggtgaacggtggggacagaagcccagactctgtctggagtaggggccctggagggacacacacccacttcctatttggctctgtcctatatgcaggcattttttttttttttttttttttttctgagacgaagtctcactctgttgcccaagctggagtgcagtgaggccatcttggctcgctgcaacctccacctcctgggttcaaatgattctcttgcctcagcctcccgagtagctgggattacaggtgtgcgccaccacacctggctgatttttgtatgtttagtagagacaggatttcactatgttggccaggctggtctcaaactcctgacctcatgatctgcccgccttggcctcccaaagtgctgggattacaggtgtgagccactacgcctggcgcatgcattttttagaaggaccttgagatgatttactattgttgatcaaggaagaagatgaagcggggagatatgctgccttgaaagtgtcctttgagcatgcagccttatttcagctgtatgtcagggtgtgtgtgtgtgtgtgtgtgtgtgtgtgtgtgtgtgtgtgtgtgtgtgtgtgtgtgtatcagggttgctgctgaggagttgcattgcttccctaaggcccaccagggagattcctgtgagggggtcagacagggcctttgaagttttatgtgttattaaagaaggtcgtatcttattaccacaaagacctgggatatctgcagcagggagtggtagaggagaggctgtcaggccagcccttaacagcgtaactctctcattccttcctcagttcctccttatcctcctggcatccagctccccatcagaaactgtgaatcctaagatatgatgggaccatggacccttcacatttttgtcatattcattatagtggttctcagccttggctgcatgtcagccacccagagtgtccaaattctcctcacccagaaattctgacctcatggagctggggcaggatccaggaattgatattttttaaacctcctcaggttgattctagcatccaaccggggtttaggcccgaggaccacagcctgccagttttcgtgtggcgtgacctttcctgccgatgataatgctgatgatgtcaagcctagctgaacgctgatgggcagtgtctgattaatcgaatgaagtaaaaataaacaggttttaacttaatgtacctccccaaatctgtaaagagatccatggatgacatcagtgctgtccaggatggagtaagcccactatcgtccattccactcacggattagaactcaaaactctgaacagaatgaaaagcaaccccatcgggaagggggttggagcttgaatgcgcagcacattagaatagagtttctgtggttgggtttttttccctcctttgatctgagtgctgactgatttgggaaatagcacagtgggcagaggcagcaaaactctgtgagaaacccatctttgtggccagagggttgaaaagaggaacgctgcaagctgaagattaggagggatcactgttttgttttgtcttttcctctctcctggccctgccagacccagagcagtagcacctactaccctgagagaaaatccaactctctggttggaggaaccggttgttgcataaaggtggtgggaagaatccccatttttttctctttctcattctgctttgccctcagcaggggctgcagttgcaagaaactgtgaaagagtgtgatgtgttaggctaaaactctgggagagccccaactttatgggcagaggaaccaggaaaaggtgcatctggtagtagcggaatatggaagaaatcttggagaggggaaatctggaaaagagggtttatttatgtttctgaaccaactccatgtatgggatatacccagagaaccatagcaaaggctttggatttaagctgcaatagaaaccgtggcccgggtcccagacttaatccctgaatagctcgtgcttgaagccaactcacagagcacagcaaagggttttgaaaccgcactgacgttaactccatcccctaacgaaggggaaccagagcttgtgttctcaacctgagtggatttatcgtctgatgaagcagacacatgaaaatcaacattctctacattctcaacattctctctcattcaacatttttaatcagggttaaaatgtacatattaaagcgatctgggatgcaatctacaattatttgggatacaaagaagcaaaaaaatctgactaattcttcagtcaatcaattaaaaatattttttaaatgacccagttctcaagggaaaaggcaattaacaaatgtcaaccctgagatgacatagatgttgaaattatcaaagactttaaagtgactgttataaccatgttccatgaggtaaaagatggacagttctgaaattaacagaaacatagaaattcgcagcagggcaatatgaaaaaaaaaagaaaaaaataggaattttagaatgaagtaaaaatattactggatgagttcaaaagcaaatgtatatgacagaagaaagaatctaagttagctctaagtagatcaatagaaattatcctgaataaaagaaaaatgagtttaagaaatgagtaggccaggtgtgatggctcatgcctgtagtctcagcactttgggaggccaaggtgggaggatcattgagccaggagtttaagatcggcatgggcaatatggtaagacctcttctctactaaataaataagtaaataaataaaattttgctgagcctggtggcacacacctgtagtgccatctactcagaaggctgaggcaggaggatcacttgatccccagaggttgaggctgcagtgagccatatttgtgccactttactccagcctgggtgacagagcaagaccctgtctcagaaaaaaaaaaaaaaaagcaattattaaaaaaaggtatcatttacaatagcatccccccaaaaaagaaagaactacatataaataagaaaatatacaagatccgtatgctggagactaaagaatactgatgagagaaatcaaagacccaactcatggaaagatatatttatattttggaagattcagtatagttgtgaattctccccaaatcgacctatagattcattgcaatcccaatcaaatttccagcaggatttaaaaaactagatattgataatgggattctaaaatttatatagaaaaataagggatcaatagtggaaacaatggttagatccctggtgaaaaaatattcctgattacatgcgggagaatttcccagaagatgaaaaacaagggaactctgaactttgaataaagggcacatgatccttatggactttcttagttctctagggctgctgtaagaagtccacagactgggtggcataaacaacagaagcttactgtctcagttctggaggctggaagtcccagattgaggtgtcctcaggactggtgcctcatgagggctgtgagggaaagtctgtcccatgcgtctccgtttgcttgtggtggtttgctggcgatctttgatgttccctagtttagagccctgccttcatcctgtttgtgtgactgtctccacaattcccctctttagaggacaccagtcctattgggttagggcctacgcaaattactgtatgtcaactaattatatctgcagtaatccccttcctctctctctctcgctgtctcttcttttctttctttcctcactgtgttgccaggctggagtgcagtggcccgatctcagctcactgcaacctctgcctcccgagtttaagagagtctcctgcctcagcctcctgagtagctgggactacaagtgcatgccaccacgtgtatttttagtagagacagggtttcactgtgttagccaggatggtctcagtctcctgaccttgtgatccgcccgcctcggcctcccaaagtgctgggattacaggagtgagccaccacacccagctgcagtgatcctatttctaaacaaagtatattctgaggtacaggggatgagaacttaaacatatgaattttgaggggacataattcagccataacacggatgtggcttattttaaatctacacagtactgtatgcacttggaaatgactagaaaaatgtgaaaatcacagggcaacaagcagaagcagacttttccccctcgagtcttgtggccgcttctctgggggtgacagatttctttgtctctgaggatggatctggtagagggtgtatttagcagtgtacttctttgcacggggtcctggcagctgcagaagctgcgcccctttctccagcatgttaagaaaaaggtcagtgctggtaacgttctgtgttcagttgccctcttatctggaccctcgcttttcccctaaaggcatccaggagcaaacatgacatgcagaggtagactttgccaaggcaccgctatttccagaagttcttgtgggagagagttgacttcttactgttagacgtaacccaggaagaacagcaaataccggccaggccagaagtgcacacagttactctgttcctgttacggcattaatgctgctttcaggcgtggactacattgtgagatattgaaaatgccatttcctggagactagtattgatgatgaaggtctgacagcaattttaatgatgtttaaagggcagatcatcgccctttgcgtatttcgagatgaggatgcagtggggcagatgtctcagcatattgaatgcccagaaggaagaagttaggcccaacattaaccccaagcctcttccaagggctgctgagacttaacacccttcccaccgcagaaatgtcacctgacaggtatggctgcccaaggcttcctgggcttttttatgcttgtcttttttatgttatttgtctgtagaagtactatagccaggaatgactagaggaaggaaataggtaccattgtcccatcactcgaaggcagcccttgctaacgtcttaatgcatttcttcacagttgattctgtgtttatttgttgtgaataaatcataacaatacatattacatgctaagccttttgtaaatatttcagatgccacaaaattgtcttgtggaagtgctaacactgatttatctaggatcctgttattgaaggtttagtgtgtgctcaatatttttgtccatttcactgccgttttccaaagagaacacatccctttgtgaccctaagctaggttagagagccttgcttgacagtgttggatatcagtattgtttttggaagattaatttattagtgtcctttcagagcttgcggttgcctgtgatcttgaagtgaaatacttattcggtgacttttgtctggaatgcttgggctgattatacaagcattctccaggactgttcaaacccacatcatgtatagtgtatagtgaaagcaactaaattatatttgaaaggaacaaaataatattatctttacaacatgtgagaccaaatgggggacaagattggtgtcaggaacaatttggctgagtctgtttctcatttgtatgatacgttttcacccagcctgtattgtggtcactgaatagctatttttcatctggtctgctatattactagctcttctaagcaccagctaatgctattttcccgtgcaaaagaaaaacatggtttagaataaggacactggagctctttattgttgacaatgagcctttatttctcacatctaattagaatgtttcaggaggcgagtggtgagcacggtgtcgggggccgcattagctattgatttatgtgctgttatagaattaattgagtctggacatggagactcattttcttggacatgtagcaggtaatcatgcttctcctgtacatttgaattgctttccagatggtgtgttgtacaggatttatctttaatatgattgactagaagcaaaggacctgagtgtgtttgcatacatgctctgcaatgcaaagcccccagcccccactgtagagatggttaactctctcctggccacaccccccctgggctcatatggggacctgggccttggattgacactgtatgcagcaaagacagcgtcaaagggtcctggataaaggctctgggaggggagaaaaggcctatagtatattctgagggaaacagaataaacagcattacttattatgcaaaaccaggacataatgtgggttcagcaggggaatagttagtgtcttagtcagctcaggctgctatatcaaaaaacaccatagacttggtggctccaacagcagacatttatttctcacagctctggaggctgggaagtctgtgatcaaggtatgggcagattcagtgtctgctgaggtctgtctgctttctggttcataggtggccatcttctttctgtgtccacacatggtgaaaggggcaaggcagctctctggggtctttttcttctttcttttttccttccttccttcctctctccctccctccctccttctctctctctctctctctctctctctctctctcgtctcgcactgtcacctgggctggagtgcaatggcgtgatctcggctcactgcaacctccgcctcccaggttcgagtgattctctttgcctcagcctcccaagtagctgggattacaggtgcacgccaccatgcctggctaattttttttttttttttttgtatttttagtagagatgggatttcacaatgttggccaggctggtctcaaactcaagaccatgtgatctgccagcctcggcctcccaaagtgttgggattacaggcatgagccaccacgcccggcctggggtctctttcataagggcacagtcccactcatgagctccaccctcatgacctcatcactccccaaagaccccacctcctaatgccatcacactgggggtcaggatttctacatgtgaattttgggggcgatgcaaacattcagtctgtagtggtcagatgatatctattcagctgggaaataggatgtagccattaaaatgatacctatggagagcttgtgttgcttaccgcatgttaaaagagaacaacatggatttgtgtttacagtaaggtctcggctatgcaaaagagatgcacagataaaagactggaaagaaagaaaccaccaaacaaacactggctttctatgggtggaacaactgtgagtgggcatccattcctctctatatttcctattaagaacacagagcaaaacagattgtagtccttgttgctgggaagtaatgtgccctcagaaacagtcaccctctgagtacagaagtctgcccacatcagtttcacaaatgatgtgctagatgattagtcatatctccggctctctcctgccctcctacagggcagctgtccccatataacagttgtatccctagaaggagtatgcagttaaagtaattggagattctttgaccagacgttttgagagtctggcagcccggaaaggtgggatttggcagctatgtgggaccttccttcaggcactaaagggcttcctgaaaaagttgcttacacattgaggtgtgttaaatggaattctttatcataaggctgcaaactgcttctgtgcaaaaggcaatgtgttagttccttgcaggaatatgcttttagtgaactcaatgagataccagaaatccagtaggagaacactttctttgaaagaaccacttgtttctacctacgtttttgcccacctttccttctcacctccccttggccacaccccacttttgtgtcttgggaattatctgctgtgctctgaatagccccgtcctgccaggccacccacctttgcccttgtttgaagaagctggggacagttgtccttgctctccaccccctggagtaggggaagaaggcttggaatgtggtgggcctaggcttcttggtgagggccttgtatttgttgacaaggaggtcagatccattccctgggccgtcatcagagacctgcaagcatctacttagggcagagttttcaagtgcagtctttggacctccaacatgagaaccacctgcagctctagacctggcctttggcccacaaccttggaatcttgggccatgaacctgcacactctccaggtgggccttgtgcccaccaaagtgagcgaatcactgcattggaggagtgactcttggcttttcacaaggacctctccctgctttcctcagtccctccaagatgcacccatatcccactgcagggatgcaatttgcatacatagccagggacagtgtcatctggccacagccactcccagccacctgtgtcagcagagttccccgttcccatctaagacattcacctcatcaggcatctctcctggaccatttcattgacattttccttaactccctttatgtagtgtttatggagttcaggcctgcactggttgctctcttctttaactcgcttcaagccctgcaggcacatactgtcattttcagtttcctaaggaggggaaggccatctctccattaaatatcttgccccaggcctcacagtaaacagaggtctgaattgaaacaaggaccttcagtcttcatctttaacaggcgggctctttgtcttataccaaaagtgccccagtaggttccgtgtaattctgtggagtctttgaagacgtggctgccttctgggtagctgctgtgggtcccttaccctttgcactcatgggaaagagagctggatcagaatgtctgtggtgtcaaactcaggaaaagagctgccattagccagcgctagcattgtagtcatggtgaaaaacgggatcattaccagtccacagccaagccatattgcagcctgaggcaacaggaaaaatcaggaataccaatcctatcttcatttacaattttgatattttgttcatcatggatttattttgccttagttttgatttctaaagcattgcattaaaatattatttatttttgattgcttaggtttttggggcctccctgatctccccctggttcagccatcgtaaagtgaaagcattttcattgcaatgaggaataagtcaagggtgcctgttagtgccattgttaactcctcagggaagtgcagggcagggtagttagacaagatgaccacatgccggaaaggggaagcaaaatggtgacttctgaaagtgacatcatttacctagaaaaacattatcaactaaaaactattaggatttaaaaatagcttagtaaaatctatttttacaaaatcaatatcattttttttctgtatgccaacaataaccaggtaaatatataaggaagagatctattcgcaacagccacagaaatattatatttaagaaaaaacttaatatgagatgtctacagctataaagaaaattacaaagccgttgagagacatttaagacttcaataaataggaagatttttttgggtgaaattgggtaaaaagactcagtattgtaagtatgaataatttctgaggccggggcacggtggctcactcttgtaatcccagcactttgggaaaccgaggtggctgatcacttgaggcaggagttggacaccaacccggccaacatggcaaaacttcatctctacaaaaaatacaaaaattagccggagggtgatgacacatgcctgtaatcccagccactcaggaggctgaggcacaagaatcactttaacccaggaggcagagactgccgtgagctgggatcgtgctactgcactttagcctgggcgacagagcgagaccttgtctcaaaagaaaaaaaaattccctaaagtaatttataacttaaagttactccagccaaaatttcagtggaatattggggatacttggaaccactaactcttaagttcttttgggagaataaatgtgaaaatagcaggggaagatgacaaaatgagaataatgagagagaacttgccttatgtcgtattaaaatatgctctaaattcataataatgaaaatggcatggtactgttgctgggcagatagaaatgatgtagactagaaagtccagggacagatctaagtttatgtaagaatttagtgtatgatggctgggcggggtggctcacacctgtaatcccagcactttgggaggctgaggcaggtgaatcatgaggtcaagagatcgagaccatcctggccaacatggtgaaaccacatctctactaaaaaaaaaatacaaaaattagctgggcgtggtggtgcgcacctacctgtagtcctagctactcgggaggctgaggcaggagaatcacttgaacctgggaggtggaggtttcagtgagccgagatcacaccactgcactccggcctggcaacagagcaagactcagtctcaaaaaaaaaaaaaaagaatttagtgtatgacacgcagggtgaccagccatcccagttcctgtggaactgagggtttcctgggacatgagactttgagtgttaaagttgagatggttggtcactgtaaaacatgagaaacagaatagtctatttagtaaagggtattgggttacctgagtaaagctgtggtgcccacactttgctgtatattggaatcacctgggaaacttttatgaatactgatgcctagttcctatctgagacattctaggttcattggtatgtggtgtgacctgggcatcagggttttcaatgggtaacaaaacttgaaaatcactggggtaaccatcgtggagaacatgaagctgctccctaccttgtgtgtttacactttctgatgggttaaatatttcagtgtcaaaaataaaggattctagacagtgactggatttgcttgctccaagggaagaggtttgacccctcccatgaaaagtctggaacttctggagctagggacaggtgcagcacacagactcagggagtttcaggggagcaccttattcctgtgcctctaggaagggtggacattttccctggaagcaagcagatctggctgaggacagcctatctctgtcatacctaaaaaatacaggcacctcttcacatctcaacagtgaagtcccagatgaccaccctgactgcctccagctcaccataaaatcctctcccactgtatcttacactgcccagccatccaccagtcgctgaaagacatgcactggtgtctcaggggccctttgttgccagcaagagcaaagacaggtcacatgctatatcttgctgaaaagtgagttagtgttttggaaggtcaaatggaggaactaatttataccacacagaaaaaaatgtgaaatgggtgctatgagtgtaaagttcagtgatttggagggcaaattccagagatattccagaaagagaaaaaggccattagggagagaaataaaaaagaaatagcaagaatcttcctgtaactaaagtaagatgtgggacttgattcggaaagggctcaccaaatgaatctcacataaaattaatgagaccctcataaaattaaaaaagacccttatctagacatagtttgctggaatttctgaactctaagagtggagaggaaattgtatcagcttccagacggaaggaatagatttttgtaccaaggtaaaaagaatctgaatagtattaaaatgcacatctgcgagactgtaagctagaagatagtggaacagtgttagcaaattattgtgaaaaggatgcaatacaataatcttatacctagcaaaggtatcattctatgtgagatcagagccattttatagatacaaaagagttacctcctaagtaaacaaaatgactctaacaattatttttacaaaataaaaatgaaatcccactaaatagttcaagagaaagaaatgcaaaaagtataggaagcagtggtaagttatgaattgagtaattatagtccaaattatattgttgtcgtagtgttatacatctggaataaatttttctgaaatcatctgaaggcttggagagctaataggaaacaccagtggaaaataaactcctggttctattgtagttctcctacaatgtcctcagtgttttcatttttgaaaacttgaataacattttaataggatctggactgttccatgttactgtaatgtgtattttagtccttatgtcctatattggcctagagaatattttatttagtgttggtatacatatttatatgtgcatattacagattttatccccccgaatgacagagattttgaagttaagatagcaagagtactgtgtactttagtttgttctcttaacaaggatgtgcataccttcaacgtgcacagcttgatgtcagagcctggcgagaaacagggatgctgtagagatggcaccgctatgcaaggaatgggagctgtgtgctcatgtgccagtgatgtaccatctgccctttgccgtcctgacgtcaagacatggacgtctggttgcatgttagcagctgcattcagcacatgcttctgagagaccgttttgaggaatgtagttactggagattgtgtctgagagttgtggttgctaagtccctgacatcactcctgcagcctctctcttgtggctggctgtcctctgtgaagataagaaatctggtgacaagttatatgtggtctttgaggcagctcagtgttcttgatgtgtcctctgacacatctgggttgcagatgtcttagtgagtgctggccccttgttctcttctagggaacagctctttcgaattgtcctgccagtttcagggtttgcgaatggggtgacgggccctgcagggtccatctcagtgacaattttcctggtgtgggacatctttgctgtctgtgggccactctagggggagtgctgtgaattgctccgcataccagtgatgctcctgaaacacggccatggacaagcctgtgcaggtggcggagtaaacattgcttctttagatgtcaagtgtccttggagtgaattcacacgttggaagcatgtggctccatcagtaattgtgcccacactctgagtgtctggactggatgaaataattatctccttcttcgttcttttgggaatattcatactgctgtaaccgtgaccatctggtacactcagtctcataacaagatgtgttttgggcaccactacaaacaaggtgctgtgtttggagctctggggggatacacaatatggaaggccttgagtttgtggcctaaactaaagagacaagaggggaagaggaggtacaggaaggcaagatgagagcccgggcagtgactgctgagggtcactgatagctcctctttcatcttcacttcctgctcccatctgagcccagatccctttgcttctgccacctaaggtcctcactgagccacttctccactgtcctctctactgttttagtttaagctctccttttttttctttttaaaaattgcagtaaaatagacataaaaaatttagcattttaagcattttcaagtgtgcaagctcttaactggactactggaatatgtttttttaaataattgaactatcatgcaagcaaaaaggcatgtgtaatgtaagagtacagtttaaagaatatgacaaacatttggggaagcaattagctgaagaagtagaacgttgctgggcgtggcggctcacccctgtaatcccagcacttttagaggccgaggtgggcggatcacgaggtcaggagatcgtgaccatcctagctaacacggtgaaaccccgtctctactaaaaatacgaaaaattagctcggcatggtgggggacacctgtagtcccagctactcgggaggctgaggcaggagaatggtgtgaacccaggaggtggaacttgcagtgagctgagatggtgccactgcactccatcctgggcgacagagcgagactccatctcaaaaaaaaaaaaaagaagtagaacgttaagcaaacttttggacgtcctctgtgccactttcctgatgctagccccttgctttcccccagaagagagaatagccttttcactggtctccctgcctctagcctctagcctctgtccccacgccaggcccagagagacagggctaaaagaaaaaatgttgaaaatggctcagtgactgtgcacatgtcttagtctgttttctgttgctataacagaatacctaagactggttgattataaagaatggagatttgtttctcacagttctggaggctgggaagtccaaggtcaaggtgccagcatctggtaagggccttcttgctatgtcatcccaaggcagaggtgagaaggtgagggagaatgagaaagagagcaagagagagccaaactcacttttataacaaacccactctcacaataaagaacttcctcccaagataaagacattaatccattcatgagagcacagccctcatgacctaatcacctttcaaaggtcccacctctcaacactgttgcattagggattaagtctccaacgcatgaactttgggggacatattaaggccatagccgtgtggtttgggggataaagtgcagagtcctgggcactgggtccaggccctctcccagtttggcctgccaggtctctgcagctgccctgtcaccccacgatacctgcaggctgcggctgcaccctttgtcctcttctccccatggccgagcagtgctgtcccctctgctgagccctccagcctgccacgctggggacttgtgtagagcttttctgcacattgctcagcctggatggtccctgcgcatccagttcctcggtgaacattgttcagtttgagggggaagaggagggagaggatgggataagcctgaaggggaaggtacccaagatagtctttgaggggtcatggatttagattgggaagagttattgtccctcctcattggtcctcattatgtcttcttaatgaaagctgctcattttcttcgtgagagcaaacaacctgatcttctgaccatttgtcttggtcacctgggctacccaaactgagtgagaagtcaggaatgagccggtaggttcctggggagaggcgtgtgtcctcgtgagttgccggtgcctcccttgactgcttttcccggagctctgtgtgccctcgttctccttggtgtggatgcgtgttgttctgatgatgagttagcgggggtggggatggcgcactgtttgaacagatgtgccctcacatggctgcgggaggacgtggtgggaggtgctgtggtgaagtggccccacacatggctgggctttgtggggttttgactctgtccttcccaatgttcctccccacagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatgggcctgagccagggcctgaggactctgtagaggcctgcccacccatcaaggccagctgcagccccagcaggcacgaggcgaggcccaagtcgctgaacctccttcccgaggccaagcaccccggagacccccagagaggcttcaagcccaagaccaggaccccagaagagaggctgaagtggccccacgagcaggtaggaccctggctgtcctggggaagggagcagaggggcccgagagcaagggacctcagggtacaggccttgcagatgctgaagcgaggcggtggggggtgctgggtgcctcacagttctaatggtggctgagctcttcattggtccagttgggagacatgttgcgtggatgctccggccactcttaagctcaccgctcagactcaggactaaagccggttgagggctgagtggcaactcgtgtctcgcagaagacacccctcctcccaccctagaagagaggttcgatttcttgcccactgccctggtctgctcatggtggggcagtatgtgtgggagagcccctcaatcctcaggggtgtactcagaccagcagggcagtggcaaagacgtgggggtgctggtgctcacccactgctgcggccagtgttgggtggcctggtggctggggtcggggccagagtgcatttcacaatggacgggtctctgaaagcccgggggccttggcctgatgggcaatcagctgtgaatacctatttggaaaaggattttttgaaggtttgacaaaacctcggggaagaaacgcatgctaatgagggcagtggatgtcagcataactgtattttaattatagcaaagtcagcgtgcattctaataaacacatttgaaaagccaccttccaaaaaaagcctcactgtgagtatataaagaagatgtgattattggacttgtgtgaaggaacttctatttggccaattatgtggacttctgtcatatttttttacagccttaactgttaaatatttttttccgagaagagttcatgaatttgagtgtgtgtgtgtgtgtgtgtgtgtgtgtgtgtgtgtgtgtgtgtactgagagcttgggtttggaatggaaatcattggattttcagcacttatattttaattgactcctggattttcagcacttgtattttaatgtcttgtattctctctaaagaacgttaagtgtcagttgacttcactttgggggtgttcctgtcattcacagcaattccgtgtttacagggggctgtgggatgcataggagctcccatggtactagtgggtgttgggagagttcacccctaaggccaggaggctctggaccctgggtctgggctttaggccaaagcaaagtgtttctttggtctttagcagggcctgggcttgtcccacaacagtggtgaaggcacctcagggattgacgtgggctgtgcagagcgtgtgacatgctgcgtcttattgtgacaaatggcatcgctagccaagttcttgtcaaagaagattatctttagagcgtggtggggagtaagcaagacctgatattttctggttttgtgcttcatgctaaccagatggtaatttgggtaaaaacacagagatcttgcgattggagagctgggaggtaaatgagtgggaatgaatggatggatgggtgatagtagctgtttaaaagggcaggtggaggtaggggaagtccccagccattgtggaggatcaagaggatgtctgttcttcccagaagaggcattgaatgaaaaagtatgtcacttctccccctaaggagaatgtgtccttgaaggacatgctcttgtctgagacactggaaaagttcatttaaactggttaatgattgtatagcttttgttttgttttgtttttccctccctccctcctttctgtcctttcctcctttcctcccttcctcccttcctccctccctccctccctccctccctccctccctccttctctccctccctccctccctcctctctctctctctctctctctctctctttctttctttctttcctatcagttcacaaattaattctgtcaaggggaacacctgctagttccagagttccaggctgacaagtaccctggtgccaggggccctgactactctttctgaagactctaccaggcccgctgcacgtgggcagggtctccacattcttagatttgagtaccccattccagatgaggacctctttgaaacctgaccagaaagagccgtagaattcatcttgaaagcaagattttttatgaaggatgtgcactgggagatttggtgctgccttgcttgaaataacaacctgctttcctaagaacaatccccttcctcccctgggggacagccaggccgtgccaggagccaacaaaggcctggcctcaagcaggtgcacagggtgccatgtgtcccatgctcacctctctgatcccagtgctgtccacatagtgtagtgatccctatggttgaggctgcagtaaaaaaaaaatctgaagggagaaatgggcaatattggtcacttagatgctgtagactcctgtttttaaccctaacccagcagcattggcattactggggagccccgcccccacattgctgaatctgaaatctgcatttcaacaagatgccacattccagctgtgatgctgtaggagactcacttggaggaaattgtgtagcaaccctcccctctcttctactcattttacagcttgaaaaagtgtgtcctggatattttgaagaggactgaatagcatttagtcattgcacgaatggcaatagtaaaatagagttagaaaaaatgggaagatgaaaaatgtattctccatggtccctactaccctaacggatgagctatttcatcagtgtgccttttcagaccatagcattgagcataaatgatgtacgtagctgtcatcataacccagatgtatttttgtcatacagtttttaaaatctgatgtatgataaatgtttctccatgtcaccatataattttcatgattatttgtagtgacctttccatgatccatttgggcgatgatgtgctgtataacatatttctctgtacacactctaccattgagcatgcagattgtgagtggcattttctcttaggtgtaaggctgccacagacatctttgtacaaaccatgttttccttctttggtttattacctgaggataaatccccatgccgtacatcaacgttgaccatttcccctcgatgaccttgcctaattgtttcccttcttctgtggatgttggatgcatgccctttatcttttggggtttggatgcatttccatctcatagaagcactctctacactgtaggtgtgacttcctgttgcgtatgtcctcatctttagtacattttcttttgaattttggttatattattttcaccatctctgcagcatttttaagatgttaatgactcatctgtgacccctccacctcctttcggtacagagggatttaattggatgtttccttcttccctgtctgggtagatgtattcacagaggacattgctttggtctggtcgatacgaaaaatgagttgccggctgggtgcagtggctcacacttgtaatcccagcactttgggaggccaaggtgggcaaatcacctgaggtcaggagttcgagaccagcctgaccaacatggtgaaaccctgtctctgctaaaaatataaaaattagatgggcatggtagtgtgcaccagtaatcccagctactcaggaggctgaggcaggagaatcgcttgagcctgggaggcagaagctgcagtgagccgagatagcaccactgcactccaacgttggcaacaaagtgagactcccacctccaaaaaaaaaagaaaagaaaaatgagttgtgcctgtactaagaagtaggttgtgtggcctttggagccctcctgagctgtaggatgccatgcattttgaaaaggctccagtttgcagggagccctcccacctgtgccactctgctgagaccaagaggtctgcccgggggctgggatatgagaggcacaaaggtgatagagtttctaaaattgtaggaagacaggttggggaacagagatctacacttgaattattttagtaaaataaaaaaaggttatttcaaagcactgcaagtttactgaggaaaatttggaaaatacaggcaaaaaaatcttttgccatgtggcattgtagaattccactgtagagttttcaaatcaaagagacaaacctaggtcaggatttcccaaaacacgctcttagaggtgttgtgtaaacaaagtaccatttgatccttactattcatggatttgatatttgcaactttgttaacttgctaaaattgatttgtaaccctgaaatcaatactcgtagcactttcccagtcatttgtggaggtacagagaggggaagaatttgagtcacccaactctcacgttcccagctgaggttgaacaaggctttgccttcttgtttcagctctcatactgtaaacagctgttcttttcacaatctatttaatgttctttgcatttttgttgatatgtgtgtgtgtgtgtgtgtgttggtgataaaatggccctcaagtgtggtgctgaagcctagtgatcctaagcacagaatggctgccatgtgccttacatgtgctagagaagcttccttcagggctgagcgacagtgctgactcgtctatgctgccactctgggaggtgctaaagtaaacttctgtagcgtatgatgaagttaaggaaaaggtggaggaatggctaaatttgcagattcatgggacaataactgattaaaaaacacatagtggacaggtagaaaacccaagaactttactgtcttgtgatctagggtcagggaaatgttaaactcttctcagctagtgttttatgttaaagaaatattgcatataattaattatttataagaaatctatattaaacaaggtgcgtataaacagaaacacacataaaacaaggttctgtgttgattcattgacaaaaatgtgtcccgaggctcataggaacctaaccctgtatcgcccctaggagcaatgtattcagtattcatcaactcagtgctcagggcagctttacagaacataactatgtgaatgagaattggttgtatttggttggcaaatgactttgggaaactttgctgcaaagtttttcccttcttgggggtttactgatttctcacacacaagtagcataaagtcccacgttcgctatagcggagacaccagccagcctggccagtgcttcccaaacatggtgtatcagcaagcccttttccctccatgcagggtctgtgggagaatacagacccaagctttacaccctggggagtaaaggacccgtacacatgaactcccaaggcctctccctgtatgcttcagttccaagatgattcagcaaccccaaatggtgatgatggaaaggttgtcattgtgttatcatcaggacccttggcttctgcagatttaacctttcttattttgtggtttgtgtaaagtccgtgggtgccggtggaggtggcagcagtgttggcggtgactgccagcaccatgttaggggtgttaggaatatgatcgcagtaaatcctagagcaacccagagagagggagctagggttagtcccgtgttgcagatggcacagttaagtagctcacctgtgaatagactgtggactgtgttatgccaaaacccgtgcctctgaacagtgcataacacagcccttgaagaacctgagaagagaaagcgtccagttctgttcagtccgcgtttgagcctgcctgctggagggtgagtcagtgtgggggaactgtgcagtgttcctcctggagagtgatggtctcttctcctctgttgtctgtttccttgctgttgaaaggcttggcgtgccctgttgttctcagtgagtgggatacggtgccagtgaggtgaccagtagatacggaagcctccggtctgtaaaatgtccccatctcagtgctaacgtgtcctaagttcaccagggctcaggccacagatcaaacaagtcaagtaaagattgttcatgtggcatttttcttaatttttttgagctttgttgacataacgtattgattttttttttcatgcagtgattaaggaatacatgagttgggtccagcaaggctcgtattgtgtgacctgatggaattagtattactacacctacccatgtggccctctactatcaggcagtgaagcgtgagtggagggaggaccccagctgggcactggtacctggctcagtctcacagctccagggatgagcctgtggacctggcacgtccttggtgccttcccttgaagagagtagtttgctcatcagtgctttccctggggcaactcacccacactcctggggggcaccataagagcgtttgtccagcaccaaagatcctagttctgtgggtctgtggggtggccctggatggcatgttctctggatgcctctgggtggcctgtggaacataaagggtttggcgagggctggacggattgttttggagccccatcccacctgttaccttgtgacgtctatcaggagatacactgaaaaggtcagccctgcctgaaattctccctgtagagacttactcctttggaccttggagatttctggagctgcaggcattccttgtccaggacctccatggctaccgagttgaggtatttgatttactcagcaagtgtagaatagctccacaccttggaatggcaaaccaaatatgcgttttgattatttggggttttcatgatttctgtttatccctgacccagctggtgctttctagaaagagccttctgccaatagaaaaaagaagaaaaatcaatacatggtagccaacttaatacaagttaaagggaagcatggtcgagggccccgaggccacatcgaatgcagaattgtgcatcattgctcattgtagagatgctttggccgtgacttggcattcagtagaggcttgctttttgaagaaccttctgagagtgtgataggagtctggtgccaagggagagaaggtgctaaaagcacaggtaactgggtgtgtcccccaggtgggaggcagtggtaccgtgtgtgttctgagccacggcctcacacacatgccccgctgggcagcatatgaagtgagtgtcagtatctgctttacagaagaggactgagacaagagtggcatggggttgttggcacccaggcgccccccctccatcagcgtgtggtggggcagcaggtgtgcagatggggtggtcctgcacagaggggctttggggcttgcactgcgcccaggagggagtggtctggggtttgtctaaacctggcccacagtaggatggaacttgggaaagagcctgtaggtggtgctgagggcagggggttatggggggcattggggcatggtctgcctgggaaggggaaggtcctctccagcccccaggcctcagtggagtagtcggctccctcctttctgcagccatgcctcagattctagtgtcccttgccccgcccacccatggcgtcaggcctagcactcctgctctgcatacggggaggctgcacgggagggttcttggggtgctcctgtgtcccctgtcgtctgtactgaaccccttcccgtgcagctctgctcccagcactgtgacagggtggacaccgcacctcctgctactgattcccaggattgccttgaaaaataaaatcctacgggtgtgcattgacgtttcaatcctggctggctccgcatgagcttctgaacttgatgttcagaagctcagggcccatttgctgagtcagcacagctgccttctttgatttgtatgaagccttttgatgttttgatgacatgtcaccatgggtggctgttattttcagggagcagtttatctatcaggatctgggattgcttcgggtacttttaaaatctaggtaaagccggggtttctaaaacattgttctaaaacattgtcagggcagagcatgtaaagctctcccactaccactaatagtgatctaaaaagtgcctctcccctcaaacacaccctagtcctcggggagaaagcagagtgcggtggttaggaatgctggagccacagtcaggaagccggcatcccacccggctgcagcagcttggggcccgggaacattctggatgggccacctgtgccagcagccccccatctcgtggggctgtggggaggggagttgatctgggtcagtgtctgtatgggtggggaggggagttgatctggtcagtgtctgtatgggtggggaggggagttgatctgggtcagtgtctgtatgggtggggaggggagttgatctggtcagtgtctgtatgggtggggaggggagttgatctggtcagtgtctgtatgggtggtgcggggagttgatctcggtcagtgtctgtatgggtggggaggggagttgatctggtcagtgtctgtatgggtggtgcggggagttgatctggtcagtgtctgtatgggtggggaggggagttgatctgggtcagtgtctgtatgggtagggagggaagttgatctggtcagtgtctgtatgggtggggaggggagttgatctggtcagtgtctgtatgggtgatgcggggagttgatctggtcagtgtctgtatgggtggtgcagggagttgatctggtcagtgtctgtatgggtggtgcggggagttgatctggtcagtgtctgtatgggtggggaggggagttgatctggtcagtgtctgtatgggtggggaggggagttgatctgggtcagtgtctgtatgggttgggagggaagttgatctggtcagtgtctgtatgggtggtgcggggagttgatctggtcagtgtctgtatgggtggggaggggagttgatctggtcagtgtctgtatgggtggtgcggggagttgatctggtcagtgtctgtatgggtggggaggggagttgatctgggtcagtgtctgtatggatggtgcggggcatggagtgcttgtgcagatgatgatgatgatgatgagttttcagtccatgggaagctcatcgggtctgggggaggtgggtgggcaagtccctgcacccagtttgggtacaggccatgctgggcaggggtgaggacactagtggacctgtcctcgggagtgacacaaaggaggtggtgagccctgcttgtgagataggatgagaggaggaccaggactggtcagggccacactggagctgctgggggtgaggtcgggtaagggcctcccaaggtgcccccacgctgtcccctctgcagggccctcctgaatgtggcttgtgccctgctggagaagttctcacatgcctctttctactccagagtcactgatttgggagatggggcaacagctgcacagccccaagggctgccctgattttctcacaccgaatatctaataggaagttagctgagaagcccacacacctcttcttccaggtaggcaagctgggcctgggactacctgtctctcaccgactccaaatgatagccaagcctctcttaaccttgggcaccttttttccagtttccaccccgaattcacactcttcaaagccagctcctcctgctgggctgctcctgatgtggggggccggccctccctgcaaatctctggcatggcccttgcaaattggcacctgccacgtggttggcactgggactgcaaaggtgaaagtggcattatcctgcatttgaaactcattctagagggagacggatacatgagactctccccgcccccatccaggtgtggccaggctccagacgagttccaggcaggcttccaggacaggctccagagttagggacaggcggagaggctctgtgactttgagaggggctttgggaagtcagccgacaaggtggggatgaacatagaggtgtgtgggtgtcctcagcatggaaggggctggaatcgtgatgtggctttgagcctgaaacaagacaaagggaaggcgagggacatgggttgggggatggtgatgagagagagacagagggttccactgggggcatggaggggagccaggagagaactggggagctgaggggagggacattaggaaggccagatgtagcagggcagttaggagatatcttactggggaagaaagcacccgttggcggtggccacctgttggcggggtcccctgagcctgagcagctctggtggattgggaaggcagaggcatgggaatggtagatggacagtgtctatagagacttgcacggagggcccaaggaggtgccagcaagccgaggtgctcatagtgtgtgtgtgtgtgtgtgtgtgcacgcacgcttgtatgtgagatattgacttgcattgtactcatctgccggtggggtgtctagggcagattgtggggagtgagagcattgggtatgggacccaggctgtccacgtgcgtctgcttcttgaggccccgtacctcccgttcttgggcctccgtgacacctggcatcatgcctctcttgcaccagaggcttgagagacacccagttggcaaaatcagttagtctgtgacattccctaggaagtgcagggctcggtgcaagaagttatagaagtatctgtttaggaagaaagatcgcatggctgaacacgctgagatgcgtaatgtcacccatggtgtgcttgcccaagatgtgatagcgtggtgatggcagacatgggagttttaccccaaagcattcagatcacaaccagtgccagtcagttactatgaagacatgtgactatggtaatagggggctgacctattagaataactcctaatcctatgtcagataataccatgggcagctcaagaaaactacgcacaactcagacatgtggagaaaggagatgtggaatggaatggagccctctgggctgatagaggcctccaggacttgccacacccacgtctgcccccaattccccagtcagccttcacagaagagaagttggtctctctccagctgagaccaagccaagacccaaagtgctggagctgaaggaagtttgggctaggctcacagaagctattgtcccctcctccagtgtcaacagctacccatggtccaggcctccatctggtcctggtccttttaagagacactgggtgctgactcacttctgggtctgtcccacgggtggcctgcctggtctgctgtgggtgcagccagactgtgcaggttcgggagcccgaggtggacttcaggtagggagacgctgctccccaagagctgctcgggtgtgacgtcagggtggaggctgttgctgtgtgtggcggcatcagtcatttaccctctttctcattagcccctgtccttcggcccatgtgcttgcaggtggcctctgattctgcttctggagactgtctgccccctctgattcattcattgcggccccagttatgtgaaagatagcatgttcattattcattcattgggccccacttttagatatacttgtgttcatcttcgagagagggaggtcatccagccattccccagtcctcaaaacccactccacaggcaaagcagtggtgggtcagggctcctcttgctgcattgcggccttgtatttgctcttctgagccacaagcatagcgagaaagtacaaaagaaaaggatttcaatggtattcaccctgaaaaaggaagaaaattgtgacacaggctgcaatatggacaaaccttgaagacgtcctgctaagtgcaatgagccagtcacaaaaggacaagtactgtgtgattctacttctgaggcacccacagtagtcagagtcatagaaacaggaagtagagtggcggtggtcaggggctggagagagcagggagtggggagctggtgtttaatgggtgcagaggttcagttgtgaagatggaagcattctggaggtcatcggtggtgatggtcgctcaacagtgtgaatgtacttaatgccactgaattgtacacttaaaaatggttaagatggtaaattgtatgttatgtatacttaccacaataaaataaataaagaaaagaagaggtttttcagtgaataactggtttgaaccaatttggatcctctaaaaccaagttgagccagtctgaacccatgtagccattatcacaccgtgttaggctattcttgcactgctttaaagaaatacctggggctgggtaatttataagaaaagaggtttaattggctgacagttctgcaggctgtagaggaagcataatactaacatctgcttctggggaggcctcaggaagccttcaatggtgacagaaggcagagtgggagccagcacttcacatggtgagaatgggagcaagagagagagtgggggttggagggggaagcgccacacacttttaaacaaccagttctcttgtgcactcaaagtaaaacctcacttactaccaaggggatggcccacatcattcatgaaagattcaccccatgatccagacacctcctaccaggccccacttccagcattggggattgcatttcagtatgagatttgggcagggacaaatatccaaactatatcacccacaaagaagcaaaaacattttgggccaaatcaaaactatttagatgtagccacagtggggatgaactgtgattatacccattcaggcctgtggacctgtggacctggcgtgtgtggtcgtgaggcggtgggtcggcacatccctgggaggtttcaggaggacattcaagaccaaaatgagccatgagtaaataacacaaccacatcctgagtgggagtaggggagcctccccttctctcctaggtcttgtatgggtcatgatcccgccttggcaggagtggaaggaacagatcccacaggctgtggcttatggtaaagtgattgtggtcatgccttgtgagtgtcattaaaataaacatatatcgttaaatccaccatcaaataacagctatttctgccatcctctcgccttttccacaagtttaaatatcccagatattctactgtgtatattcctaaaagcagacaggtagatttagtaaagttaactggatcattggtaccttctttatagatcatctggtgaaacttgtttttcaaattatgagttgtagggctttgttttaatgtctgtagccttaggcagttccattgagactaagtttttttcttattaagactaatcttattgactggaactgtggactcctcgtattaggagaacagagatgtggcctacataaattagtggaagttaaatactgtagaaaatgctctctggaaaccaaagtctaacatcgacttactactggtcattcaatttccttttggcttgggcaccatcgttacattcatttttcagatgtcaagctagttttctcagaatgtgtgcagggctcgaggccaagtgtggaggccacaggggaggtcacaggtcaagccttctgggagaactgcaagcttgagcctctgataaagtcacgcgattgaattttagccccagtaggttgctgtcgttaaactgtgcacacagggcttcttgcttttaagttagcaggatggaaaaattgcggatgtttgcagcaaatgtgtagaaccagtggcagaagcagccatgctggcccctaagcaatggtattagaaagggttgatgaagattttctcatttgagagttgaacaaaaccaaatggaattctccctagttccgcagcactggtgggtgactctccctgggccggtctcagccctgcagaaaggggcactgtctgcttagcttggtcagcgcagggtctactgcagcagagtgccaggtggatcacagccctcttgtgggggaaggatgggcggagctcccaccttccccacaaatggacacagaatggcacctggtatgtgaggcaggtgcaggtgaccaggagaaggggctgtcagtggttgatggacagctgcctctgctgcctggatgacccaccccctcccctggaccatctcccactttgcctgggtgtcagtcactggagggttagctcagtacaagctggcggatgacctccgtagagcttaggtgaaggggctctcacagggcagtatgtttgagacccttagagggctctctttactcttgcttctcctattatttttaaactgtagtaatacacacgtaacataaagtttaccattttaaagtgtacaattcagtggcatttatcacaatgttgtgcaaccacctctgctctttagttccagaacattttcgctgcccccagaggagaccctgtatttattaagcagtcactccccattcttccctccgcccccagcccccacagtgaaaaatctgttttctctcactttggatttgtctattccggatattccataaagataggatcagacaatatgtgccctttagtgtctggcttatttcatcatcatgttttcagggttcatccctgttgtagtgtgtgtcagtactttgttcatttttgtggctgaatgatattccactgaatggctattttacattttattaatccactcatccactgatggacatttgagttgtttctaccgcatgattaatgtgaatagtgccactgtgaccatatgtgtacaagcttttgtgtagacacttgctttcagctcttttgggtgtatcactaggagtggaattcctgggtcatgtggttattcagtgtttaccgtttttaggaaccacagatgttttccacagtgacagaacattttacattttcaccagcaatgcatgagggttctgattactttcaaaggaaaaaaattaagcagccctgtcaccttgatggtttggtctctggcctcaccgcttcagctcctctggcctgatctcccagggcctgcttttgttcatgtgtgtgtctgtttataccctggctcatcctgtggagggtctgaggctggcaggatcactgggttctgtctccacattggaaggtgagctgtcctaggtcagggtctttgttgcatgcatcgtcctgtccttagcaagagctaccctgtgccatatgggacatacaacaggcacctgttcaggcctggccatgtgggcccacctttggatggtacttgacaaagcctcaaaatgcagtgacaagtttagataaatatgattctgttctgaaatgctgcactggacacagccatccactgcctgccctttacagggctctgtgaagagacagtgaacaatgaagtggaggacgtgtgcaggtggccccagtggtcggtgatggaggagagatttcagcagaccaagcacggagaataaagccaggccagagtgtgctatcagcctgtctgccccctagagctgatggactcagcaaataacagtatagggtacccagttacattcgaatttagacgggtataggattttggtttttcaagatgaaaaaacttatagtggtgagggttgtacaacattatgaatttaataacactgaactgtacactcaaaaatggttaagatagtatattttattgtatgtgtattttaccataataagcaattgaaaaaataagttgtatttcaggtagatagcgaataattttttagtataaatatgttccatgagatgtctggataccgggatgcaggagggactccccttcctcctcccattcacaggcctgcctagagatttgtaagtacagactgactggctgtttttcccagtgtgtcttgtcgtgatacttttaagccacagatccgctttgaaaagatatgatctcccccaggggagtaactattataagaacaaatactctatccaagcttccattctcctcaagataaacatcacaggagtgacctgaattgtaaagaggagtggaaggaaaagaacaataccgtaatgttttctgagccacgcagatgtcaggggacggatccaagggcgtctgaaagaagacgtccacgctgctgagtgagaccttcctctgtgctgctgagtgagaccttccatctgaccagggggtcatgctctcactgctcctgcttggagttctggtgctgtagcgggtctcggccgccccttctgagctgggtggaggaagaagtccctgttgaaatatcagatgagtagggatgatcgcctcttttgaaaacaggagccgtgaagggattcccagagaagattgtcatctaacggagtcattcgtccgcccaggacttctctgtcacagggttacgtttgggagaattttcacaggccactggggatggctgtggctagcctggctttccactgatgccctctatccctaacctcagctcctgacatggctgtcattccagagagtgcttggaagcatcctgactatgttgacgatggcctgagcggagtgagtgtgcactagtttggtgttgtttcatccaaagcaatgtgattatattgctgtactttcagtttcatcaagcaggcaaaatgagaattgacactttttaaaatccaagctttagtttcaccacctggagccaaggtgtttattagaaagatttattggcattagtgtatttttattacaagcatttatctctgtgctgaacagttgcccctgagtcccgtgtgctgtgaagagtctgtgccacaccacacattaattttctgtcctcagagctccggggacacacgctgattctcatgctgtgcctgccgccttctccgagtgatggctgatgtgggtttcaggccccactacagttactcagcgacagatgggaccccgtgtcctctgttggctgtagggagttgaggcgaccctggctggcatcttgttttgaggggtggctggctgctgtactttggggagggcataacaggatttaaatagtatctttatctaggatgcctggagccccaaatccatgtgggcctcccactgtgtgaatttcagatgctgccagccccccaaccccgccacccctgagatggaaattagagcaccagatgggctctcccaaggagaagcatcacaagcccaccctcctgcctctttggaaagtaaccctggctgtttattgtgagatgtggttgtcatggtgacaagtggacacccgcttgggagggagatagaggaaacgctgttatggaggaaaggtcacccctagagacaaccttgtgttgcccgtggacaccccatactatggcctccgtactggggagtcccatgggtagggcatgggggtgcagccatcagtctgtgtccccagccaagccttgagccctggcttgaagttgcatgaaggtacagtggctggcccagccctaacccgtggtggatgcagcccctgttgtgtcccccaacccctgacttatctggccgcctgatgagagtctgtcgccctacatctgtggcgctccctctgcctgacaaattaaatcccgcccagcttgcaggagggatgttgttaacctgatttcatttgctggtgggctggttgatttctttggggtttttttggagatgaccagcacctgtccagcaactagtaaggcagggaaggcctccaggaacccaagtccatgcagaagggcactgtgttggggaactttcagacaagtgggtaaaataccgacgtgtgctatgtgcaccttgaaatagcaaagtgtcctcaacagagctctctgggggatgtcccaaataaggtttactttaggagaatgtgagcggcatctgaggcgagattctcttgttgcatcctttggaagcttttgcttggtgttccttggccatagcaggaagatcagtgccagggatgggtgaggggaagaaaccttgcaggagcggtacctgggccagtctcagccctgcagaaaggggcgctgtctgctccacttggtcagtgcagggtctactgcaacagagtctcgggtggtcacagccctcttgtagggggaaggatgggttttgctcctgggatgctaggcttcgaaaagcagggcagtgtgccagcagtcccagacaaaccagagccgggcctttggtcatgccaggacagcagggtgtggtctggctaggcctgtgagcccctgtggggctcaggggtaggggcagcaggactgggggaggcagggaccaaccagacttcagaactgctgggtcccagctgcacccctgcaccacctcagctctaggaagggcagccccatgtagctttcttgagatgtagcagcagtgctctcccttctccctcgccatccttaaagcccggtgcccgctcccctgcatcccccactcccattgcctctgaaatccggtggtgtctgtgatcctggaggggaggcttagccagcaatcattccaactacctggggcacggcatatctgcccccatcagtgctgggagggtgggcccagatcctttaatttttctcaaaaccccagagaggcagagttccatcaaagagcaagacactgatagactaggacaggggatagggctggcagccatgcctcgtggcatcacctgactccgagagaagccagcccaacacttggggtctcagttttctcacctgtcaagcagggggaagaatattcattgtgtacacaagaggcttttgtaaaccctaaggtgctaggtaaattaggtaaatgtaactttttttttgagactgaatctcactgtgttgcccaggctggagtgcaatggcgccatctcagctcactgcaacctccgcctctcaggctcaagtgattctcctgcctcagcctcccgtgtagctgggattacaggcatccaccaccatgcccggctaattttttgtatttttagtagagacagggtttcaccatgttggccaggctagtctcaaactcctgacctcaactgatctgtctgccttggcctcccaaagtactgggattacaggcgtgagccactgtgcccagctggtaaatgtaacttttatcatcagtgtcttccttgccatcatcatattgttatttctcgataatttatttccagaaagttctggaactggacttaccatgcaggctccggaacctcctctgggaggtggacagggatttaagggctatggatctggcttctgtcttctggatgatataaggaactaaatagagaaaatatacctaaccttaaattttattaattgaagtagaagcagttgtagtttggtgtcttctttaagagaagacttatgacatgtacttggggcattttctatgttgtagtaacagattggctaatttgcatttattctcatccaagaatttaggttttttaaaaatatggcttttaactttttgggcactcttggtgggaacgtaaatagtactactgctgtggaaaacagtatggaaggtccttaaaaactgaaaaatagagttatcctatgatccagtgatttcacctccaggtatgtacgtaaaggaagtggaagtgaagactcaagagatatttgcacacccacgttcatagcagcaccattcacaatagctaagaattggaagcaacccaagtgtccatcaatagatgactggataaacaagaggtggcatgtacacacagtagaatgtgattcagcccttaaaggaaggaaattctgccatgtgcttcaatgtggacgacccttcaggacattttgctgagtgcaataagccagttccaaaagggcacatactgactgcttaatcactccacttacatgaggggcatagagctgcccaattcacagaaacagaaagtagaatggtggttggcaggggctcaggttggggttggggttgggcatattgaggagtttgtttaatgggtacagagttttagttttgggaagaggaagacattctgaaggtggatggtgaccatggttgtacgacagtgtgaatgtacttagtgccactgaactgtacacttaaaaatggtcaaatggtgaactttatgttatgtgcattttactgcaatcaaaagataacaaatttcaaaatgatttaaaataacttttttagaagtatgaaaatagaatattaagtgcatagcagtttaagtataattaaatagacgtctgcacacacacctatacacatacagacatacacatgcattttacaaaattgtatcacattgcatattcaggttttgcatcttgcatttctctaacatataaaatcacgatctttaacttccccgtttccaggtttgcaatggtctggagcagccaaggaagcagcagcgctctgatctcaatggacctgttgacaataacaacattccagaggtaatttttttcaaggatgagagttctgggctggaacactcatctaatgatggagtggcccaccgagttgtggtctgctcactttgtccatgatgttctcatcccacccggtgcctgggggagagggagtccaggtcaggccaagttggtgtcaccatatggtgaggaggtgagggcacactggcctgggaggagggaggagagggcctccctgatgttaggaccatgccatggagtgctcttgtgttgcagatggtgtgtgtgtgggggtgggggaccattggtactacttaattttataaaaagccattctattcattgtctgataaccatgttctaaactagggtttctcaacaatgacaccattaacattgaggcctaggtaatactttgttttggggactgtcctgtgtattgtagttgagcagcatccgtggcctcaacccactagatccttgtacctaccccatccccatccctgatttgtggtaaccaaaaatgtctccagacattgcctaatgatgtccctttgggaacaaaaatcatcccagttgagaaccactgttctaaatcaacaacaggttttaacaaacaatttcctataagctaacagtgctatgatggaagttatttcccctttctggtaacatagtttagatgagattatttaactttgatgaaataacgatggccaccgatggagtggtatccagtctcctttatcttgcttttaaagatgggcctggatggctctcatgccccctggttggagcgtcattgtgttggatggtccctaggctcccttctagtcaagatatgctagtctgagggcccctaagttttagatgatgggcttttgggccactccccaacatcatgttgcctgcagcagactggtttcctgtatggagctgacatcttcagaacaccatcactcatggggggtttgcttttctcattatggctcatatcacagccctgcttagccttcaccttgtgggctacctacttaacaattgttatgtgttttatttttccatatttcctaacagacaaagaaggtggcatcatttccaagttttgtggctggtaagtgactttgaattttatttctcaaggggcagttgcattttacatcaaaataaatggtgcttttagtttgggcattcacctgcaaagcttgtttacaaagcgtgcctacctaccagcaaggtgcttggccattgtctgtttgaacactgtgtagccccacttagtggggaggggaggtccagctgatctgcccgctttgatgcaaggaacagtagacgatctcctttaattataccctcactaattgcatcacagacgacactgatgactgaatagattgagatgtgtctttataagcagctggttatagctaacacttctgatcagggtggatataatgcattcaaattcaggctttttttttttttttagatcctttgtttttctttaccgttccaccctttttgaggaggttaatagtgcatttcaacattcagtaaagaatgaaactggtcgatatgttctgtgtcactcttggggatggggagcacacttgcctggctttgacggagctgagcatctggagaccttgcagggcccctgtaggagatccactgggtttgcttctagtgctccaacctcagagtaaagagcttgttcggcaggatttctgtctttgccaggaggatgtttcctgcccctgctaatgtgttataataaacaatgtgaatttcattaattctttcaataagctggtaattaattcttataaatatttatgggagcaaggtaaattagttttcagaaataaatgactttcagcccttcccatgctgcttttctttttttagcaaacaactaaagcctggggaactgaagcccccaaattcgcctttagagaactagtttgaaccaggctaatccagttccaattggttgaaactggattaactggctcaaatcaattttgactgttataactggcttaatgctgctcagattgggtgagaatctgttttaaaccatcagaattaatatcatgcaattgagatagacttggttccattttgaccaattcagataggctaaaatgggttttgcccagcagtttacatgtggttttaggtacattttatctggttcaaattggttttcttcaggccacagcaggttatgatgattcctggaagagaccacactccccacattcccgcttgtagtgtttgattgggttcctggtttataggagctggcacctcgtgagcagggcgaatgcagtacgtcactgtgccattttccttggcaggcagaagccagggtggggttgccagtcacactgctccagtgaggcagggtctcctggatccaagaagctcacttgtcagtgtatcatagtgtcatctggacagaactctcacactaggaggtgatttagacattaaattccccgacccttgaaccaatctcatatctgcagggagtgggatcgtgagggatcgggaagcagtgtcagtgcctggggtacctcggactctagctcctggcatcccagaagacttggttccctgcaccactcagactgttccaaagcaaatccaaacaaggccggtggcttaaaacaattcagacaggctaaaactgctgtgaccagctagaaccaatgtggaaaacctgaatttatagtttcttctgtaggagagaagccctttgattgttatgaaaacatagaaaactgaagcaaaacaacatcctttactattacagcatttatatgcagcgaggccttcatggaccaaaatcttactcagcaacaggaagagatcatcataatggtgatgccaaaccctagaatataatggatatgggaaaagtttctccaaattaaacaccgttatcagtttgaatgcctttgggtacaagtatcaaaatccccacctaacgttacacaaataggtgtgtgtcttacataaagaagtccagggttggacgtggtggctcacgcctgtaatcccagcactttgggaggccgaggcgggtggatcatgaggtcagcagatcaagaccatcctggccaacatggtgaaaccccgtctgtactaaaatacaaaaaattagccaggcgtgatgctgagcacctatagtcatgctatttgggaggctgaggcaggggaatcgcttgaacccaggaggcggagattgcaatgagccaagatcacaccagtatacgccagcctggcaacagagcgaaactccgtatcaaaaaaaatataaaaaaaatattaaaaagtctagaggtggccaggcacggtggctcatgcctgtaatcccagcactttgggaggccaaggtgggtggatcacaaggtcaggagttcaagaccagcttgaccaatatggtgaaaccctgtctctactaaaaatacaaaaattagccaggcatggtggcgtgtgcctgtagtcccagctacttgggaggctgaggcaggagaatcacttgaacccgggaggcggagcttgcagtgagtcaagatcatgccactgtactccagcctgggcggcagagcaagactccatctcaaaaaaaaaaaaaacaaaacaaaaaacaaaaaaaaaaagtccagaggcaagaggccgccggttcgatggctctgtgatgtcaggattggcgctgttgtgtctcttggcctcctcttcaggcttgtcacctcatcgtcacacagtgtgtgggcagccccagccattgcttctcgttctaggcaggaagaaaaaaggagaagggctgaagtccacaccagctggacgtcctccccttgacattaggaaagcaaaggttttctgtggattaagaggtgatgacttctctgcatgagaatcggaccctctgttacctttcatagtgtgctccctgggtaacctgaaaggcagcgtgtcagctgtgtctccaggcaacattgcttatggtgagatgctctttttgataaactgtatctagatgggaaaattctaatgcttgcggggcagggcatccagggctttgagcttctcacagtggtgactttcgtgactggcatgtctcttgaaggtgaccctggaagctatgccccacccatggggtgattgtgagagatactggctgctgggagcatgaggctcttagaccagatgggttccacatgcccttcttggtgggagttttgtacccttgcagctgacccatccagggagttctgtaccattgcagctgacccatccaggggcccatgagactagctgtgtgggtgcagtgtggactcccatcagagagtccaggaggcaaactggcgtctgtcttgttcccttggagtagacggccccatgtctagctgagccttaggacactgcatgcttctgaatatctagttgaaccttacttagaagacccagaagcctcttcgacacactgcttatttctttgtggccagagctgtgtcacatgaccagcctctcagatgttagtgttggccagacaatcaaaccctgggctttttatgaaggcagggcaggtctggaatcagccctgggtgcctgccgccacttcccatcccactgcgggcccttccagcctcctggcgtgtccagtgctgaggctgagtatgtgagttcctgggaagcccctgtgtaagggaggagcagctcctccaccctatttgtgtctgagaagttgccctgaagggaaatgttcctggagtattcatgagtatttggtctcagcttatgccttatttcatatcagataattgttgataataatgaaaaaaataatagtaacaatgcacatgataccgtctgaaccctcgttggggcctggtgtccactccctgtgccatgcagcatctctctatttcatgtcgcctggtcaaccaccacgtgaggagtaagtactttcccccgtctgataggttagaaaactgatgcacagtgaggctaaagtcacttgtgtgcagtcccatggctgtgcgggggacagagcctggacttggacccatgtcttggtgcttgacacataaactcgtagccgaggtcattcctccctacccagcatgccttcatataccaggaataggtaagacctgtcaggtgctttctttgagccaggcccagatctaagtgttttaagtatatcaacttaacaatcactatatccacagctcagggagagtgaatcccgggccgaaggtcaccaggtagcaagtggcagagttaggattcgaaccagtctggaatctgagctcatcaccacactgcactgcctggcgaccctcacgcagtgggtgaggaagaaccttcacttagagaagacctaccatgcaggtgccagagagttcagtggaggggagcgttccagatgccagagctcctggccttgtcaggcgcaggatcacagccttctctcagcagaggcattgtgaggaagggcctgccacaatcactgtctgtggaaagttctcggggtctagcgaccctctcagactgggaaggttaacgctgcagagaaaacctccttatgaaagtgcggattgcacagaggatgcactgcctgtcctgcggggaggaatccgaaagcagccaccctcaagatgtcccctcctacaggacgtggtgtctggcagcagcttgagcccaagctgcttagagggtcactgcctctggatgagtatatgtgaatgaccagcttttctatacaggtaaacacgtgctcattaaaaccaaaaggctgatgttagtcccaagcaatggggcctaacagtggcagcttcagtacaaaataacaaagactggtaaatcttactctgctttttgtactttgttctcctcatccaaagctcatacaggatgttttgaaacccaccaccccaccagcagcttgaggcttatgccaaaatgctgccaggccttagggtcctggggtcctttacagcctgtctatagctcatcaacttgcccagctccgtgtggatcatgtggaaggcatggagattacatgccccagacctggagctgagctcacctatcaccccttccttctctcaggggtcctcacagtggtaaagctgctttgttggtttcatacagtgggcacatgggatctgagacttagtttgctcttaaaataggcagttggggtgaacctgttcagataagactcttaaagtgaagacatctcccacctcctcctctttggtgtatttgggtgggggatggacgggaggaaggtcaccctgtgggaccagaggggatgtggcgcattccaaagaggagttatggaaacccagatgactttcctttttctacaaacaagatcatgtttctcctgtactacatgcagtcagcaggaatagggattcgtcgttttaaaatctgaacttttattcactaagtagaagttgttaaagatttctcagaatagtgcttgtatcagaccaagagctgcaagagttaaaaatgagaaatccccacagtacctcttgttctgcctatacatcccagatccctagtccttctgtatagtggaagccacttacatttcttgtgaatttctccaggaatttctcagctcatccataggcccttttccttaaatagacattgcactggccacatggctctgtacttagctttttcctttcttgctagatcttggaaacagcaataggtccacctgattatttaagcggcagcacaggatcggttgagtggatgtgggatggggtattaaccagcccccttggactgattgttgggagatttccagtcagtgcagcagtgaacagccttgtggctacgcctttgtgtttgggtgtgggttcttttatggaggcggttcctggctatggcaggggtacaggccaggagcacagcaactctgatagacacgggcagaatgccttcccaaggggggacagcgtacgctgctgttggtcatgtatgagagttggttacgtatgaggttcccacactgttaccaacactgcatgaccggctgtttgatataagctccaggccgatgggtgcaaagaggtgtcttgttgatttcacgtgtctttcataataagtgaagccaaacactatttcgtatgttcataggtggtttttcttttcagtgcactgccagtttgtttcctgtgctcattcctctgttagattttcacccccagctttattggcgtataactgacaaataaaagttttgtatattaagtcatacaatgtaatgtattgatataagtttacatggtgaaatgactaccacagccaagcgcattaacatagccatcacttcacatagctacctttttgtgtgtgtggtgagaacacttcagatcgattgtcttagcagattactagtatacaatacaggattattaactacagacatttactcatctcataactaaaggtttgtaccatttgaccaatatctccccatttcccccacccctcagcccctggcaattgggaatttgggtgtttcttattgatttgtattattctttacatataaaggaaatgaaccctttggtttgtactgtaaaagtttaccccagcttaccattcttttcttcttcttctttttttggtatgctttttactttgctaaacatgtcatttagtcaaatatatcagtctttttcctttgagcttactgagtttttgaggttagtgtgaccatcacactcctaagattatttttgaaaataaagttgttggccaggcacagtggctcatgcctgtaatcccagcactttgggaggccaaggtgggcaggtcacctgaggtcaggagttcaagaccaggttgggcaacatggtgaaactccgtctctactaacagtacaaaaaataaactgagcgcagcagcacgtgcctgtaatcccagctactagagaggctggggcaggagaattgcttgaatctgggagttagaggttgcagtgagccgagatcgtgccacagtgctccagcctgggcaacagagtgagacaccgtctcaaaaaaaaaaattaattgattaattagttaaataaaaagctgtcttccaggactttggtattattttaaattatttaaataattgatttatctggaatttatcttggtgtatttatacaggaaaagttacattttaggcattttgtcccaatagctagccagttatgccagaactatccaaggaatctttcccttgcaagtttgaaatgctgcctttaccgtacccaaatcgtcatgtgggtctcggtctgtttctggatctgttacagggacggtccattcaggttccagatccaggctgctttatttactggggatttatggtgcattttattacctggtagggctactttcagaccttgccaccatcattccatttcagatttttttcctaggtatttttgcacttttatttttccatagtaactttaaaactagcttgtctggttattcactgcaaactcttttgtttgttttgttttgttttgagacagagtctcactctgtcgcccaggctggagtgcaatggcgcaatcttggctcactgcaaccttcgccttctgggttcaagcgattctcctgtctcatcctcccgagtagctggaattacaggggtgcaccaccatggccggctaatttttgtatttttagtagagatggggttttgccatgttggtcaagctggtcttgaactcctgacctcaggtaacccatccacctcagcctcccaaagtgctgggattacaggcatgagccaccgcgcccgggccactacaaactcttactggtatttttattaggcatgcttaaagtctgtccatttaggggaaaaaatgtcagctttacaacatagtctttctagccaacaaaggatttatctgtccacttgttcaagctcatttatcttcatcggtaaagttttttcataaaaattcaacacatatcttgtttgtctgtttcttgttgttttatcccttttattgtttttgtaaatgctgactttcattatttttcaacatgttgctgtttgtaggtacaaagaaagctatcgatttttatatattaaatttgaaaccattgccttagtgaattctcttattttttaaaaatagatttttagttgttttcttgagtttttcctggcatgcaatcataccatctgcaaacaagaatgatttttgctgcttcctttcttgttttctattacttcttcttgcttaatcagattgggtagaacagaaggaacaattttacataatagtagaatatggcttcctaaaaataacacctttttgaaagatctatgcttttaattttgtcataaaaacttcaagcatatgaaaaaatagcttcagtatttacccattcatggctagtggtatttaatctacaccctgaccctttcccagattattctaaagcaaatctcagatcttacatcatagcctctttaaatatttcatattgtatctctaaaatataggagttctgtttttaaaaataatttcaatgctgttatcacaactaaagttaatatttgtttatgccattaaatatttgtttttgtttgcattttcccagtttacagggcgctgtttgaatggggatccaaacaaaacccgtctattgagattggtcaatgcatttcataattcttttatgtctcttttaggttgtccatccgtctcttttttctgtcttacaaatttttgttggtgttattgtggaagaatctgtcatttatcctgtagattttcctgcagtgtggattttgctgattgcatcttcatggtgttgtttaatgtgttcctctattctctgtgtcctgtaaaatagtggttgtttttagacatagaggcttgatcagattcagtttgattgggcaaaaactttcgtacatatttttgtgttgttctattgaggcacataatatctggtcatctcttttttggtgatattagcaaccattaatgatcattgtctagatctagtaattgattagaagttgccaaatggtggtgttctaatttcatcatttcttcttcattagttagctggaattcttctatgtagagaaactttccctcaagtatttggttaccctgaatattgttcatataagaaaagcagattaaatgcttgatttcttctcttttttgaaaaatttaaaaattaatgagttggctgggcgcagtggctcatgcctgtaatcccagcactttgggaggctaagacgggtggatcacaaggtcaggagatcaagaccatcctggctaacacagtgaaaccccgtctctactaaaaatacaaaaaattagccaggcgtggtggcgggcgcctatagtcccagctactcaggaggctgagacaggagaatggcgtgaacccgggaggcggagcttgcagtgagccgagattgcaccactgcactccagcctgggcgacagagtaagactccatctcaaaaaaaaaaaaaaaaaaaaaattaatgagtttccccgacagcctttaaaagataaccggtgaggttgtgtatgttgttgttagcacagttgatgtgttttgtgtgtgttaccatgattattggtgctcaagttttctatggccaataagagcttctttaggttgttttctgagtcccgtcaatgtgaacccagtagtctttgattgtttcctttctttctggtatattccaggatcatcttaaatatttcttgccccaggtctggaaccagttggttctttctccatggagccctgtgaaataacatttagagactgtaatctgggtagtgtggttgctcgttgttgtagatttggtgagagtgtatatgtctatgtggaaggcgcctcctaaatggcccccaaggacccctgcctcttggtattcatggctgtgagtccttccctccccctgtgtgggggatggacttactgagctgcttctattgaatagaatatggtagaagagatgggatatggcttccaagatcaggttacaaagagatgtggcttctgtctcagcttgtcctttcttgttctctcttacttgttccctctgaaggaaccaagctagcctggtgtggttggcagttgccccatccagaggcccacgtggcacaggactgatgtttctggccagcggcctggtgagagaacttggaagtggatgctcccctcttcaggcattcagatggctgcagcatcactgagtaccttgctgcctgtgacagacgagaggtcctgagccaaagtcacccagctaagccacacccagattcccgatccacagaaactctcagataatccacggttgttgttttgagccactaaattcccgagtaatttgttatgcagccaacaataactaatacacaacatattttttaagatcaaataacgtcatgattcctaatgatactttgtcaggtttataggttctaacatttgtagtttctttttcctgtgccccaaattcctgttctcaaggacaccagcataattttgcattggttttattccattaagcttacagcagtctcagaataacaataccaaacactgccaaggacacatgattgtagatacagattatgatttatttgcatttacttttgtgtttagaatacatcccacaagggatgtacagtcagacaactgtgttttaaaatattttggaatagatcacaactggatacacttttagattcattggtttcatttttctcttagttatttggactttgctttttccatttaattttgttttataattatataaaataattacatggtatgaaattcaaataaacaacacaggatgtatgcaaagaggtcagtttcttcccctatttatccccccacctcccaatttcttcccttccactataggtaaccattttgagcattttacatatttttattgtaagcatgtcttcccctttcttaggtaaatggtagtggattagactcccatatctccatcttgccttcttcacttcacactaaaccctggcggtgatgccacagctctgtgctgttcacaggagcatggagaggatgttctgcagaactccactgtgtggatagatgtctcctgttcaggagtgtttgggtggtttccaggtttttgctattacaaatagtgctgctgcagtgaaccgcctatgcatatgctttttcccatttttgccatttttttttaaaaaaaattatttattatgctttttctgggaagtcattctccccactgcaagggttaggatctgtcttgggcaactctgtgcgttttcttgagcttggctttgaccttccttccctgactctctgttgtggcttctcttcctcccagcatccagtgacttaatcttgctcattgggtgtctaaagttcaacactgtggaacccccaaatcccttttatcagtgacaaagcctgtgctgcaggcccaggtgtggccactccctggtgaatgtcccataggtgtgattttcagatggtgtcttctctttcgtatcagccatattatagggtcaccttcagtgggggcatctcaaggcacaggccctggcagtactggagagtcgggcctggaggccacgccttagctctgcagcagaaggtctcacttgagacgccagttacacgactctgatactcacccactcctgcctcctttccccactccagacctagggggcacttcagggggcaggctctcctgctgatctggtggctcgcctcctcccagtcctgtcctgccccattagagctgcagcccctcctcccagttgaggccaggtcccgtctgcactttggaacctcacacgatctgatgtcgtttgtctcctgtcccttttgctcgcccctccactggcttttgaccacgtctgtcccaccctgcatctatccacaccaccccgctctacctgccccttttctttcacagccggaatctgggagtggcagcctcattgtctgcacctcccctgcacctctcagccccctctctggctcctgccccggttcctctgaaacagctctttgaggtcacgactgacttccttgacactgtgcccaatacacgaggtctccttgtagttggcctcctgctagcatgggtgtagatgggcaggcctccctttctaagccccttcttttcttggtacttagcagagcagagtcctggggcttcatcctgcccccttgcccatgaccttccttgcagactcatccatgcctgcagcttcacttggcacctgcagatggttcattcccaaatctgtttttctaaccgggactcccgagtccagccgcctactgagcatccaggctcctgccactaaacttgcctggaatccccaacccaagctcagtcctcttccaggcaccctttctcagtgaggggcaggtctgtccatcgagctctgcaaccattgtctagcgtcctcatcttctctcagactccagtccacctttccgtcctgttgatggacccctaaatccccatctgttgctgtctctccatttccgttgtcaccctgtccgtaccatcatcaccactcatgtgctgggatggctacagtagcctctcagctgctctcccttcttcctctctgctgcctgcccctctgccagagttcatttctaatgaaggagtggttgggccacttccctgatggataccctggagtgacagtccttatggcctgtcacccgtggccccagggtcctcacatctggccagcgcttcctccccaccctcgacttgtctcagctgctggcccatgccctaggcctcggcagtccagacatcctatagatcttctaaggtgtcattgtctctgcaccctagggcctttgcacctgctcccgcctcagcctgggaggctttctcctccttttgccttatggcttgttgattccttctcctcctccagacctcagcttaaacagcagccacccccaaattcctcaccagagcagcctccctgtcccttccttcccagggccatagcctcccttttgagcattcaccatggcccatcctgatgcatttgttctgtggctgtgggactgatgtcagcctcactgtgtagcctgtgagctccatgtttctgtcttaacaccggtctttatacagtgggttcagaaatgctgagcacctgaactcatgacagtgaacttgggcaaagccacgtgacccacttagatggtccttatttgtaaaattgggaccctgagattgcttcatggcgtggttgaggactgggtggaactgtaccattgttgcacagaggtctggtgtgttgggcatgagggctgcactccaagactccgtgcctttgcagagagcagcgggccttgtggatgcacccccacactcccacatacacctgtgctccagctccacccagccacctcctcccagacccccaggatatacagggacaggtcttggagctaatgagaccccctggggccacactggcaccttagaagcctctgtccaccacccatgttcaggataattttcttcaaaggtggcaggagtggagaccctcaggcttgaagctgtgggactcccctccccttccctctccagagggcctagggttttcctaagcggtgtttcaaacagaggcttcctctggcaggggagaacctggagcgccttattcttctccagactgtgcagatacactgtgcatatgcctatgtgagtaagatatacggtgtgaaaaggataaatcactctctggggagacaagatctttaaacctgtatcttgattatcttgtcattttgtctccctctggtggtctcagcttagggtcagtgcaagacttgagcaaaataacagcaatttctacccaaacatgtagggctagctgctttcattttctaacgaagctgttagatttgggttctgcgtttcctgcggaagttgagagctgtgcccatgaatctgatatactccccacaccatgccgcccccactggactcttctctgggtctgggttctcctcccgtggtgcgtgtgagtgggaggcaggatgctggggccaccttggactcgattgtttctcgctgaacaaaagagcaaggcaggcatggaaggcccccaggcagaggtgggtggtggctggagttgcagcaaggcccttgagtgcttcactggcctcatcccggaagcaggcatccgtgggtgccagtggtgaccccctgcctgggatggggcatccttcacacacagcagtctgtgcccagatgggccccagagctactgacgctcacttcagggggagacgaggccagtctttcccaaatctactcaaggacatgggtcaacatggaaatgtgaacctcagaagggtctggtgcactgaccagggccaccctgggggctggcgagggagaagccaaggggcagtgcctagaaaggtaggagtcagattccaaagggagggctggcctcccagcctccccagggcctggggctgacagggtgccaggcagcccctgccacagaggggacataaggacactcgcccaaggccctgctcacctgctggggctgtgaggctggggtacctggggcgcctggaagaaccagagctttcctgcagaacaaagtgacgccatctagtggtcaatgagagccactgcattgggccccactgggtgactggggcttcactggggggtgcctgttgagccatgctcactggggacggcaaggtggtgtgaggtagtagaaacaggcctacctcaggcgctgggagccttcccagccccacagccagatgccataaaaggcagcacagggcatgtctggcgagcctgtggcagccagggctgtcatacacgctctccaagccccccagctaggcagatgtgcacacttcactctgaagaagcgccagggtatggtgggggtactgcattgggatagatgggtcctgttccctctgtggggctgcctctgattctcctggtgacaggagaatcccggtgtaccctctgagagacaggtggacaggggttcctcccctggtgccacccctgaatcccgcagtcccccacattggtgcctgcagccctgcccagctgggagaaggtttatcggctccagggcaaggggtgaatggaggatatttaaaagccgtgggaggaccccattgataggactcagttagatgcacaggggagggatgggggtccctgtggggagagacggctgggagcacaggtgatcctctgaccccaggggcacgcagacccactactgcccaggaaagcaggaaggagggccaagtgggctgagcaccaacgcgaagctccccacttggtctgtctgagcaggtgagggaggggcagccaggagtttgaggcagtggaggggtctggaataactcttgcatggaggaagagtctgagtttcccagagagatagatgagagttgtgaggttgtttggggggcatttggggtcaagaatttataatacatttatcatggcactcatttgccctcttgggcagctttttccagcctcaggtccagagaaaacaggttggagatttgctgaactcctgtgggcagatacacaggactggggtcagggaactgaggatactgggcggatgttattgaagtggtggatggcagcgcccaagctgggccagttgatgattttagcaacagaatgggttagaggtgagaccagggatcagctggctgagggagggaagaggtcaggaggttgctggcgcgagggctggggaagtgcaggatggctgggcccgtgatgctggagggactcagggaggggccagctggagcaggaggggagccaggaagccagggccaaaatccccagtggaaggggctctggccaggaggtgggcagtcgggagggataaagcaggtgacatggccaacatgggtctgagaggacagccaagccacggtctaggatagctcagaggtcggctgactgcagccccaatcgcaaatcctcctggccccctgattttgcatataaagtttccttggcacacagccacacctcctgttttacatactgtctacggctacctttacgcctcaggtacaacggtgaatagttgcaacagagaccacaaagcctaaaacacgtaccatctccccctttacaggaaaggtttgcccacccctagctggagccttattgtctggcataggagccactcaagattggtttgtgggcaacatggacaggacttgggggttggttggatatgactctaacatgtggctctttatatttcaattaattaaaattacatacaagaaatgggtccagtccctcagctgcaggagcctcagtgccagtgctcaaagccacatgtgggtagcggatcctgtattggacactgcagagatagaaccttccattgtggctggcaggaagtttgttgggtcacgatggtctaggggcagcagatggaacaagcatgatgttgccaagcctgggcctgcggtgtgatgggtgtgaggagctacacgggtgtcctgagaggctacagacaggcaggagcccctcaggacagatgcacaaggacaggccaaggagaagcccagggcacagtttcaggtcaccagcatgagttccggggctgtggggaaggcatggaaagtgctgttgtgtttgggatgtgacgccttctggatttgcagcctgtgattgtcatcttgagtgacagtcaactggaatgctggcattgtcctcctgacactgtttgtgcagagttttctggcccaagtgttgatttcgcgcagttacttgcagcacggggtagtgagggaagcagaccggccgcccgtggctggctgcagatggcaatggttgggcccttctagtttgccccgcatcctggctgccgtgttccttgtgctatggccaggcatgcaagttctttgttcaggggacttctcctctaggaagactctgactctgtgccctccttcagttccagggccctgcgaaccagaagacctcatcgacgggatcatctttgctgccaattacctggggtccacccagctgctatcagaacggaacccttccaaaaacatcagaatgatgcaagcgcaggaggccgtcagccgggtcaaggtagaggtgcttcgagggcccctcgcggatgcccgcacactttggggggcactagcaggagggaatatggcggggcgtaggccctcttccagctcggactgcacagccctcagcacagggggcaggagcggcccaggtgccaacgaggctgagggaggcttgcgccttggctgggagaaagctggctgggcagaggcaaccagctccttaacaagaggcccacggaatcccagaaatacgacctttaaagatcatcgttccaaagcattctagtcatcaaacaatcccaaatcccagttcaacagtatgtgtatttttagtgccattcagagtgcttcaagaaagggtgaaaaataaatcacgttttatttaaattcaggacctcaagaaaaactttgacctgcttgtagctctaagtgctcattggattgtctggttttgaacatcgggtgaggccgggcaaggggaagatgaggccacgtcagcaaaattaaatggggtcggcggggaggggatgcagccatctgaggtctcagctctctgagcaagacaggatctgcagaggcccgccagcccaggggtgagaaatggcagcaacctcctccccagccctcaccatacacaacctcctctaacagaagcagagaagcaccatgaggccatccggggtgggcaggagaaagccaggtaacccagggcagtgctgagccctgctggccagtgcctctcagcagaggcccggccctcccatcccagacccttgccttgctccgctgcctggagctcagctccccttcctgccggctgatggcatctttcctgtcctccatagatggggtggttggcagtcatttctagcgctccagggacacctgtgtgggcttctcttggtcagtgtgtgtgcttgaagtgggcaatggctgtccacccgtccctgctgggctttgctaggcaccagacctgagagtgggggcatcaaccaccaaagtgacataacctcacgcaccttccttctctctgtgccaacttgtttttcttttctcttccatgctgtcagaggatgcaaaaggctgctaagatcaagaaaaaagcggtgtgtagggccttgaggccctgggacagtgttgtttgcttgtgtttccgtggcttgtcctgggcagtgggggctggggggttcccctggggatctaaataatgttgcaaagcagcttttcctcttcccttggtaggtgaatcttagatgtttgtaaatgaaactacagacacttcatttttttaaccacccatttatggaaggatttattaattcttctttcttagcatctcctgtgtactgtatggataatgctgtgatgttcctgttttacgtggacattttaaattgatatgacatttagttgatatgacaacgtggtgggtgtagggtctgggcctcctgtgcagtattactgaattgttctgatagttaaagattccttaagcttaatttactaagtcaggagggtgagtagctcagtttgcccgtgtggtgctttctttattggaaatgagtttttgggctgggtgctgtggctcacacatgtaatcccagcactttgggagacagaggcaggaggatcatttgagcctaggagtttgagattggcctgggcaacacaatgagaaccctgtctccacaactttttttttttttttaattagctggtcatgatggcacatgcctgaagtcccagctgcctgggaggctgaagtgggaggagcacttgagcctgggagtttgaggctgcagtgatctgtgtttgcaccactgcactccagcctgggcgacagagtgagaccctatctcttaaagaaaaaaaaaagaaacaaaaaaagaaaataagtgttgaaacactggcagacttttaaaaatgggttgacactgaggccgggcgccgtggctcacgcctgtaatcccagcactttgggaggccgaggcgggcggatcacctgaggtcgggagttcgagattagcctgaccaacatggagaaaccccgtctctactaaaaatacaaaaaattagccaggcatggtggtacatgcctgtaattccagatactcgggaggctgaggcaggagaatcacttgaactcgggaggcaagaggtcgcagtgagccgagatcatgccattgcactccagcctgggcaacacgagcgaaactccatctcaaaagaaaaaaaaaaaggattgacatcgagtcatttgtttgtcacctggtcatttagtaaatgctagagcttttccaatcctcctcatacagaaaatatcaaaatagttggtgtcacaaggcctggggcaaaccccggggtccttggcactggcttattgcccactgttttcttctgtttaaacagcaggagatttagttccccctccctgctttgaagtaatgccattttctggcgctttggccagaagacccatgtggggactccctcttctggagtgagactttggtccacctaggatgtctgccttttgcccagcagcgtctcctttgattctgctcaggagcaggagaggaaggatcatgctcatgctcctcttcccgggctgatttcctccaggcaaggcagaatgtgccacacattgcagacttgcagttggggtgtgcttttctcaaaagagaggggccctcgcttgcagcctcctagtccagctggagcagggagtccctacggactgcagctggcttctgggacctgcaggtccagcaatcctacagagtcgctgccgcctttagaggggttggtacaggcagacccagctcaaaaaggcctctgcggccagtcaggtggccgcctgattacatttaattacggtttgttcttcctttttggaaagtgggatgctcagtgtcattgctgaaggtccctttcctggcccggccacagccatggggatgactgcaggtcatgccccccatccacagacatgccgaggcccaccctgtggcctgttctctggtgtctgtaggatccgtactgtcgacaccctcccttcttctgccaaggaggatgatgggtgtcctctccctgccctgttactgatgggttttccactggaggctgggtggcttcaggctgcccctcttctcccatccagggatcccagcctcaggtttcctccacaattgtcactaatgccaaggtccacctgcaacttttctcacttctggcttgacctactttttagcaagaggattttgagccacaacccatgaatataacctttaaatgcatgctgatgctgaatataacccaattttaaaaaacagaaaaagttcctccgcggctgcggattgtcagctgcactgctttcaactcctttctctttctaatgagttaaaagcaaagaaagcccaaaagaccctttcccttgaaaattgagctaaaatacacatttattattacaataccgggcctctctaaaactcaaaattcttgaggaattgtcagcagggagatttcttatttcagattttctagtgaataattaaatcatagtttttgctgtttcgaaatggaaaatagaccaccctgggctccccagtgaccacggagaattattcacctcggtgggcaaaccaatagaacttgaaattcattgccaccgtgcagtggtaattaggattcttacaaatgtaaaaaccaattaaaggctatcctagtttggggcagactctgaagagttcactcagctcagaagagcccatgaaactcgtctcacaaccatatgccagacatactacagtggctacaggtgacgaattaggccatttgtgtggcacctctcttggcttctctctgtcgctgtgaggacagcacttaggccagccccagggctcagtcccccaaggacgctgtgggatggacatggtggtgactgattaaatcagaaggaaaggctgacattttcattcagcttctctgacaatgtcttccccatttcttaaggatacttagaatcccaaatccaggaaacgtaacctgagtctataaattccacaggggtcagccagagggccttgcttgccactggcaggaggggctgtggcgacagacccaggcgtcccgccccatctcggtcaagctcccgggggctggccctcctccctcccaggtgcctcttacagactgcctcgagaactcacacttagctagatgatgcggccggtggcgtgcaggtagatttctgatggccagtagcatttccttctacgtggactctgggtaattgttaaaattgccgagccttccttcgagttattactttttacattgacggataaaattgtatgtatttgttatgtacaacataatattttggagcatatacacattgtgaaatgactatatctagctaattaacgtgcattacatcacctagttttaatttttgtaatgagaacacttcattcactatcttagcaatttttaagaatatgaaatattattaacggtagtcaccatgatgcacaatagatctcttgaactcatttctcctgtctagcaggagctttgtgtccgtggaccaatacttcccccttcactcctttgccccagcccctgataaccaccattcagctctctacttctgtgagatcgacatttgtagcttccacctgagtgagatggtgcagtatttatctttctgtgcctggctgatttcacttcacagcatgtcctctagggtcatccatgtgttggaaatgacatggctttttctttgtgaaggctgagtaggcctccagtgtgtctgcgcgccacatttctttatccattcatcgtgaatggacttcgggttgatcccatgtcttggctgttgtggatagtgctgccgtgagcatgggagtgcaggtgtctcctagacacgctgatttcacttcctttggaaatatgcccagcagtgggattgctggatcacatggtggttgtagtttgaatttttggaggaaccgccattctattctccacagtggctgcactgattcacaccctcccacagtgtaccagggttcccttttctccaccccacgccagtgcttcttatcttttatctttttgacgagagccattctgacagatatgaaatgatatattgttgtggttttaatttggatttatctggtgattagggatgttgagcattttgtcataatgctatttgcatgtcctctattccgagttggtttttggactttaacaatatccactgtccttcttagaattctgagggggatgcccagacgctgacggaagtggacctcttcatttccacccagaggatcaaggttttaaatgcagacacgcaggtaagcgtttaagacagttgttcaaaatcaggtaaactcctaagttcgactccttcttgtcccatggtataggccctcgttctcagcagcttctctcctgtgctctctgcgcccatcaacccaaggcccatagcccgggctgcgggaggagcaaggagcgcacagcaggtagcagtcgtgctggcgtcaccccagggctctgcgggcgggaggtaggtgggaagacctgctgggctacctgggccctcccctgcttccccactcccgggtagcctgacctctggggacagaggaggcagcagcccccactatgtggctcacactgcagcccaccactcccaacccagtgccgtgccctgaccatcctccaggccctcacataccctgatacgggcacaggggcgcccttcctcatcccatgtctgtcctgtgtccaggcttgcaccttgtcccactgatctttgtgtcctgcacccccctaccctggaaccagccccctcctggagcctggcacttggtgaaaactcagggagacaggtgccagggctcaggcactgggcttgcgacgcttcacagactttgacttcattttctgatcttttgtgggcaaaccatctggactagatccccccaccaaccctccgagccccatgcctcatcacccacctgtgctgggtgtccccaagaccaccacaggctgggtggtttggaggactgacaggactcagtgagctcacagctgagatttatttcagcagatggctccagagcagaatcagcaaagcggatgcaggcttccagagccctccccgcagtcacacaggacacactgaactccctggcaaggggctgtgacaacagagaagttgtgtctaccagggaagctcatagacactcagcccaaggtgtttactgggagttggtcataggcaccctctgcctggcagctaccaaaattccagactcccagaggcaaaagaggtgtccagcctagaccacgttgtttgcacaaacggtttaggcaaaaggaaccatggttgtcagttcgggtgctgggtaccctcctgagatccacgttcccagatgccagagagggccagccttgcaggcgggcctttctgggtacagctgctaggcctgccccagtacctcttcttgccagtgtacatggagggtgccacacctggggtgggaggatgggcttggggattgaagctgagccccatcctcatgagctgtatagccttaaacaagttcctgaacatctctgaacctcctaatacccacagccccagctgaaagagtaactcttccgctggatcctgtgaaggagagatgagaaatctcctaggctggcccagttcagggttcactccactggccccttctcccttcctttcctttcccttctggatctttggattctggacagggcatgcaaattaaagctgttggggcagaggagctggagaggagggaacaggtgagagactgggaaggccaaagtagccattcagagcaggagagcagatgcggccatgttggtaggcagcctctgtgaggaggaggagggatctgccattgataggagctggggaaggaacatgtttctgacacctggggattgattcaggcatttatgacagtgacagaaatcaggagatgctgaagagccactccaactgtttcctttcagtgtccctccctggaaggtgactcttgtggttatgaaacagcctcatggctttggccagaaaaaaagtcagcagctgagacaaaggtgaagcagcatgcactgcaaagtggattctgtgaggaagaaatgaggtccagaggttgcagaaacactcgagtttcttttgtgaacagaggacaaaagcataaaagaccagttgattagtttttttgagctttgtgtgcagtcttgttaggtaggggttgtgggcaagatgctggctggagattcctgtccaaggacaaaaaaccatcaagagtcatgggcctgccagaggccgagggaattgaagtcaggtgggctaccttggtgtcttttgacccaggcccaggctgtttgggctccctgggaagagctcattgaatgacaaacattggccttgatgctttcctcttctgcacagcaggaaggccaggccaggccactcttgggcccataggagagcacctcgttcagaagggacccttctccagagccactggtggcctctcatccgggaatgtatgggtttcactatatggcaagcccctgctccagcagagacagcccgagagctcacctgacatcacgcctccctgggttctgcacagtccattttggaagctgggactgagatgagggcagagtgactttgactgtaaatcattaccctaaaacgctctgttaattagggccgtggttctcaaccagtgtgatttttgtccctcaggggacatttagcaatggctggaaataattttcattctcacacttgggaagagggaggtgctactggcatctcctggggagaggcttggaatgctcctaacaccttgcagtgcacatgacagccctccacaataaagaatgatccggccccaaatgtcaggagaatcagggttgcgaaacccgaataattggagtgccttttttttttttttcctttctttttttttgagacggagttttgctcttgttgcccaggctggagtgcagtggcgcaatctcggctcgatgcaacctctgccttcacagttcaagcgattctcctgcctcagcctcctgagtatctgggattacaggcacctgccaccacgcccaactatttattttatatttttagtagagatggggtttcaccatgtttgccaggctggtcttgaactcctgacctcaggtgatctgcctgcctcggcctcccaaagtgctaggattacaggcttgagccaccatgcccagccctggagtacttttcaatggattgtcccagtagtgttccctgacgtggcactgtctccctcccgacaggaaaccatgatggaccacgccttgcgtaccatctcctacatcgccgacattgggaacattgtagtgctgatggccagacgccgcatgccccggtcagcctctcaggactgcatcgagaccacgcccggggcccaggaaggcaagaagcagtataagatgatctgccatgtgttcgagtcggaggatgtaagtaagcccttgccagggcactcccctcccaaagttcacagcccagggcggctccaggatccaggcgctgtggaaaccaccctcaggtggaaagcctccatgctgttactgatgtttccagtggatcagtgatcttttgcatactctttgggtttgcaaagatagtgaatacagttttattctacttcttgaaataggttcttcaggagctgtttataaattgagttgtggttaaatatatgagggagctatttgaagaaatccctttacaaaacattttctctactaaaaatgaagttaatctttgcataacttttgttattaaaatgcaaattttcgcatggccctggcatgctgtataaagaaagcacatctgcacatgaggcttagttctgcctttgcgtgtggtcttcagaggaagtaaaaagtgattctgaagtataagataccaaagactcaggaaaagatcacaagccctttggctccctccttggctggagaagagtgttgtttttagcctggagggggacagaggggctgaggaaggagcagcagggccaagaggggagctcagagaggaactgtccttcctggaggctgatcttactcacagaccagcagggggcgctgctggtgagccagttttgtggctgttgccagagtgaaattttaaaatatgatctatggctgggcacggtagttcatgcctgtaatcccaacacttttgggaggctgaggtgcgtggatcacctgaggtcaggagttcaaaaccagcctggccaacattgcgaaaccctagtctctactaaagatacaaaaaaattagccaagcttggtggtgcgtgcctgtaatcccagctacgtgggaggctgaggcaggagaattgcttgaacctgggaggcggagattgcagtgagctgagatcgtgccattgcactccagcctgggtgacaagagtgaaactccgtctcaaaaaaaaaaaaaaatctatccttcaggggcagttggccagggcgttctttttcacataaggacttgaggctgtctcagggacctgggcaatagggaagggtccccatattgtcatgatcctgacatacagcatggaaactgaagacagggttcaaacctttggctggcgcagtcatcttcttcctaagaacttgggtccacttgaagtgcttcggcgcaatggcagatttacaggagggagagagcatttcaacagcgcactcacacattccttccaccgctacacggagacccttcgaaacctggatgggtatttctgtgtgactgagggccgaggatgtgtgagagacctggcttggggatgggccacaggtactggcggaatgaggccaggagcaggcccggtggcgaagggtggcagtcagctggtgagagtttccaaggggcactgagagcccccaggtgcagccgatgcggagggttaaagccagggtatgccgtattgggtagatgaggccgcagggtggtcctgccagcaacagcagcctcctcttccccacctctccagcgcctgcaggctctgcccacagcccacttgcaggaggccgcttgagccctgaggtggggcctgggctgggctcctggactcacagcagtgaacgcccacaggcttggctgcgagttggggccggcagggcgaccccttctctgaagcgccagccgcagagagagccccctgaaccccacacctcccaggaggcagccggtacccggcgtggagtgacggggaggcggcggctggcggcacaccagcggcccagatgacaccggaaggaggcgcagccccgcggagccggctccccgggcttggagcttccgcgggggcggaggatgtcgtccaaggggaggaagaatggcggtggcccgagggagcccaagtggagtccgagggccgtgggtggtggagccgggcctccggggctccagggctctcaggccgtccttcccagccaggtggcctcgtcaggcggagacagaagcagaggcctgggggccgccctccgctcttcccaaaggcccgaccctctcctgcgcgggcgctgcccccggccctcctgccgagccccatcagctcgccaactccgcaggccagcccggcggcgccatctggcggtccccgggcgtcgcgcctccagctgggtctgtgcgcgcggcagagatgctgggcgtgggaaccggcaagtcctggaaacggcttagggcccgtcagggagggcagttccacgcctgctggagggcaggccgcctgctgcgcgcttctaatccggcccagcttgtctttcccaatgcatacattcatctgctgctcttacatcctgccacgtggagagtgggaagggaattgaggccaaagcccttgttttcacctgttttgggatcctgttgagtaggagtttgctgggggcgcccgtgcaggacccccttgagggcagttggggaggcacgtgaggagcaggacagcgcataaggagggctcacacagcccagagcctggcgggaggccccgctgtgggctgaggcgtcaccaaggccgccaagagccccgccgcgctcccagggctgcacagctgccagcctgcttggcgagctccgggagctcagtacagccctcacctcccactgtctcctgtctgcgcaccagcaggcggccggccaggccctgagtgctgtttcagtgtccaggcctttgccatgtcagagtcggtgatgtccactgaagcagctcagcggaagtagaaagaagtgacgtgcttcatggggcctgtgtggagtcccaggtctcatgtcttgcaggcctggcctggcacagccacacatccctagaagagcagccaggcacaccctctgcctccagtgggcactgggttctgttgctaccgataaatacatgcggggtagacaactagcagcacgatgctcccggaaaacacactgaaagtccattttcggcatcagatgagtggaaaggaaatacagatggggtcaggtgcagtggctcacacctgcaatgccaacagtttgggaggccaaggcaggaggatcacttatgtccaggagtttgagaccagcctgggcaatatggcaagacccctatctctacaagaaaactttttttaattagctggatgtggttgtgctcacctacattcccactccagtctgggcaacagagccagacctcatctcgaaagaaaaaaaaagcaacaaaaatatgacatgtagtaaataattcattgttgtcccagactttctttgaaacagctttgacctggagcatctgggccgtgccacagcttaggcagggacagtcaggagtagaccctttggggttcagggcaacactggggttcgctcacggtggagtgctggtgggagacagccttcatcagatgagggagggcccccagtttctttcttgttcttctaagcccgagcaagggctcccttgaaggcttatgggtgcatcctgcacccagccctgccgcagccccctgctgaggaggctgcggggagcctgtgccacgtgcctgtctccagctggcctgccctctgcacaggcccagctcatcgcccagtctatcggccaggccttcagcgtggcctaccaggagttcctgcgagccaatggcatcaaccccgaagacttgagccagaaggaatacagcgacatcatcaacacccaggagatgtacaacgacgacctcatccacttctcaaactcggagaactgcaaggaggtaagccacacccaccagcctcagggaggccacatttgccagcttctgctccctgagctcctgcagagcgagccttcccggggtcctcacgcacacccttgccttcctatcagactccagtggggcccggaatgtgcacctcgctcctgccttccagctgagcacttgggtgtgaaatgaggtgtttgtaacaaagaagctgattacagtcagctttaatgacctcgaaaatgcgccttttaatgctgctattatcatcaaccagcactcagcacccaggagatatttctgaaaagcatgtggcatctctaaagggagcctgggggctctggcagaggaggctggaagccaccagtagcagaggccttagctggtcccagtggcttcccccaggggactttggaaagttcttatgggcagaggagcaaattccctggggatggcccatacctggactgtttgttaaatggctgaatgattgtgtctgctgtggatgagtggatggtctctgctgcttgttgaatgggtgaatgcatgatcctggtttcttgctgaagacattccaggcagtttctgagacagtgacctttgagaggaaataaaagtagaaggacttttccaacaagagtgaaggccgggggcaggatatgggtatgggagcctgagaacattcctctggcctctgtgggtgtggaaggagcaggaaccaggacactggagccctgcttggggtgggaaggtcagtgttgggcacgggtggggttggggtcaatgccaggcacgggtggggatagggggtctgtgcttccaggttcccaggattgctgggtggaccccaggaaggtgtgggagccagactggggtgaggctgggggtgggtgggcagggctcccagcccaagacctctcctggctgagatgagccagccttggatcccagggcagggcgggatgtgccaggacagggtcagcctcatcctcctgtgggtccttggcagaggcctcggtccttgccgccagcccctctcacactgctgatccctttgcagctgcagctggagaagcacaagggcgagatcctgggcgtggtggtggtggagtcgggctggggctccatcctgcccacggtgatcctggccaacatgatgaatggcggcccggctgcccgctcggggaagctgagcatcggggaccagatcatgtccatcaatggcaccagcctggtggggctgcccctcgccacctgccaaggcatcatcaaggtaggcaccctgggatcctccgcccaggggtcacctcaaccctgcctcacttcatccccactttgctgcaatccccacttcactgcaatccccacttcacccatggggaaactgaggcccagggagacccacccggtgactggtcgatgatggtatcagaatttgaactcaagaccattccccatgtctgaatcagaggtggacccgggctggcctggggtgggaagggaggggttgtctgagccctgtaccgagccatgtggccctgggcaagggcccaagaaccagtgagtatagggtgaccagcttatcctgctttgcctgggactttgccaggttagcactgaaagtccggcttctgggaaaccccctcagtgctggtgggctggggaggtggggcaccctgcatgggttgggttctgggacgcaggttcccttaagtaaggaggccaccctgaccgtcagactcgtgagcttgcagctttgggaggtgctgcctgtcgctgtgaggggtcaggcagaagggtcaccggcagctagggtgggggccttcacactggccgcctgcgaaggaatgggttctgcctgctgctggcggctcttgtgacccagctgtggcctggcccccagccctctgtggcatgttcctccccaccctgctgtggtcttggtgctggaggaagcgccttcctcctctttgttcggcatgagagatgaagggcattccccaggccagagcatcccatagactggctctcggagctggcccggcagagcgtctgcccgatgggcagccacacagagagacatgggagaggcctccaccagtggcaccagagggctcagcagttgaggccccccctcccagggctgcagctcccaggtggaggcttgggttcctccctgtgcctcctcacccccaccggaccccggcggcctggcgcacccgctgacaattgcgtcctcactcacagagatttgctgtgtggtcactccctgccctgcaggaggtccgtccttggagggcattgggttttgaggaaggtgtctccacatccttccgtaggaagctgtcccgaattcggcatgatgatggccccctcgacaccctgagggtgacctggtgccaggtgcgttggttctgcccagtggcactcagaacctgggctcgctcctgcagtggctaatcttccccagggcagaggcaccctgcgcatggtgggacagagggcgcagtgctgccctggaaacctggtagctctggtaagggccagggcgaggcttgtccccgctgcacagaggggctaccgaggctgagaggggactgcctgcctctcccattgtgtgttctcactgcccccggcctccaccaccctgccagcctcgctcatcctgggtcaggcttgatgtctaaggcccagcctgtgactcctgtccccgtgctctgcagggcctgaagaaccagacacaggtgaagctcaacattgtcagctgtcccccggtcaccacggtccttatcaagcggccagacctcaagtaccagctgggcttcagcgtgcagaatggaattgtgagttccccctcctgctctgggccaccaccaccactgcagggcccagggagggggagcagctcccgtccaatggggcaggctatgtctggcagcctggtaggacctggcctgtggttgcagctgcccacagccaggccacctggggcaggaactttccatggctctctgggaggtcctggctagaaggggagggccagggcatggccgtggattgggcccctccagcctttcccaggctcccttgtccccatggtggttgtcccctgctttggagggagggcagcagacttcaccagccactgtagcttggacacaaccaattgtggcatcacttactgtgctcaacaaacagacgttcactcattcattcattcatgtactcatcattcgcttgttcactcagccattcagcagacatttgtgaagtacctgctctgtgttaggctttgtaccaggcaatgggaaggcaggagtgctgcctggaggaggtgatgctgggcttgagtgagtgtggttctggccaaaaacctgtaccagttccccaggccagagttctttagcccagagtttccaccctctcactgacctgcatttgactggcctgaattcttttttcctttgtttttcctcctgcaaaagacccagagggcagagatgtggccactaagtggagtaaagaagaaaagggctggcaatacccaaattgtttaaaccagccctgagtatgaaggagcccaggaggagagacactgcgggctggagtgggagttttgtggaggtgatggggagggtgtgtgcccacccacagtcaggaaagacagtgggagaacattctagaaggactaccaaatcttctccattgttttctggtgaagcagcatggagggttacacccaccgtcagggtggagtcccagggcttgggtttagggtccatctctgaccctgctgtgtcagagcaaatttgctgctataaaaaagagtctgcaaatctccatatactgagagcttattgcttattcatgctgcagtttaatttgcagtgggggcggtgggggtgagcttcactccacaaagccactcaggggcccaggctctgccctcagctgggctttggcagcccccactgggtgctctgtgtctcgctggcactgcaggaagagaggcagctcagaagaccttgtgaaggttttcagggccagggcagaagtggcccttgtcatttctgcccacagcccactggccagatagctcagccacggacccatggggaggctgggaagtgggggccagctggtgcccagaacgaagagggacaggggcatcgccagcgtcagccataccttccctgctgtgtgaccctcaacaagtcactgaacgctcactggattcccctcaaaaggtgcttgtgaagatcagctgagaaaatccataaagtaccccaagctatccaaggtgggcccgctggtcctcgtctctgccaaggaggaggccccgtggcccctggacctggcacaggtgccaggacgagttgtctgcaccccacttgggacttcaggacagtgcgcctgccgcaggagctcgccagctggtggtctggcctggtccggctctgcctgactgctctgcacacatgtgacctgggcacaagcagttgccccagctaatttgggggctctgcagaaaatcagctggagccctgtctgcagctgctgtgcgcactttgtggatgggcatggctgggccccagggaggagggctgggacatccttctgggctactgcacccccgaccatcaccaggccctgcctgtgtgcctcccaccccagcactggggacagtggaggaagctggggactgacagccctgcagccctcatgaggagccgtgctgtgcagagcctggggtgctgtatggtgtcccctgggctgcccctgcctggctaaacctggtgaccacactgcctttgcctcctgagtggcactggggagctgcttgtcctgttcctgcacccccttgcccagcctaggaggcaggtgggcctgggttggtggccagtgctgctcactgacagccctgtcgctgtgagccctgcaggagaggctggctttccccaccatggggtggcctgggggctacctactcgtagggcctgtgaatatagccctgcccgggatgagtttgatgccccctcagtctgctggtcttccccaaactataaccccatgaggagcacaggaactggagaagctggggcacacagaggtttagtgacttgccccaggtcacacagccatgtggagcactggtggggagagggggagaagagatgaggaagggaaggactccggtttgtgttttgtgggggctaacatgaatgggaaaggaggggacagcctggagcagcccagccaagcccaggtgcagggttctgtgcctttcttcccagagagctggagagtgcaatgggcaggtgtgaagtcaaggcggagggcagcagacggggaccagggctcgctccagctgccttctggggcaggtgcagaggggtctggagtagctcccaaagatggggcaaggtgggtccgagtggccaggaagctgagggtggtggtgcggaagggggtttctcagaagatcagggggtgcagggttgagggcagcagcagacttgcggggcctgcagtgaggaaggagtcatgtgcaattctgaagacaacatctccggggtggcaatacgaaagagagggtgccacccacggctcggtgtctctgccctgggtctagggtctgagttccggagtgatggagggggccaagcgtctgtgaaacttggggggtggtctgggtcacgactggggacgaggagggtctggaggtcccagccctgcttgtggatgcgctgttgttccaccctctggctctgcctccctgtctgtgaaatggggtcccacttccttgaggcctcagtgctcaggatgcaggggagatgctggcagccgaggagaggggcaaatgctggctgtcaggggctttctccaggatacaggacagctcaccctgagagtgccagggagggttagatgaagcaaatgaataggcatggttatgatccatctccccagtgatccagaaaatggcatgcaggcggccatatggatcagtcaccatctctgagtggctcggctgcctggcggtaaacaccgggcccttcaggcccccaggtgcggaccacaccctctgcacctgctccatgagtgcccgtggtcatggtgggggttgagggtaggggtctggctgtccccatttggccctctgtgcacctagacacagaggctgtcacagtggctgccacttgtgcccctgcaggccagggctcatccaccccagggccatgtccaggcatctgcctggctgaggtgcactggggctccactgcccagccgggacctccagggagcaatgagcctgggataacattcaggagacccgagggtgctggctactctggtccaagcccctcgtccctcacagcgtgctcaggataggacccgcagtcccaagggccctggcctctactttcaggagcctggaaccccgggctcctgctgtccccggccctgcagcagtggggcgcttcccttggtgtcacctctctgggcacccccatccccaccatgcccagtgaagctctcacctgtgtcctcccgtccttgccaggcccttcgcctgaagtcctagctccagctggcctggggcagccactcggcaccttgtatcccgggagctggtgggcagggactggggttcccctcagcctccatgtgcctggccacctggggagcatatgcaggcgctggaggatgcctggctaggagtctatcagctcctgtcccgacctgcagcggttctccctgatgaccacagaaacattccctgtggcaggtggcaatgcttagcacccagagcgagcagtcagatgagatatgggccagctgcagaaatctgggtgctggtgtgtaggagacggggaggccccctcacagttgtctgtgtctgcatgtgtgtgtacacgcatgtgtgtttgggacaggtgagtctgtgcttctcccatcccaggccactcgcctcctcccagggctcagcacagtctcctttctccaggataagagggccctggggtggcgaaggagctgccttgcggtatggaatctgcctctctccacccccttctcttctagtcctaattctccttggacatccatttttccggtttttgttttcatttaaaaaataactgtggtaaaatatatctgtaacttaaaatcgagcatcatagccattttgaagtgcagagttctgtggcagtcagtccatctgcatgtcaggcagccatggccactgcgctctcctgcacgtcttcctcctccccaacaggaactttgtccccactaagcaccaccgcccatttctccttcccagcccctggcggccccccacttctactttgtctctgtgattctgactaccccaggtacctcatatcagtggcatcacacagtgtttgttcgtgtgcctggcctgtttcatgcagcatagtgtccccgaggtctgtccgtgttgtagcacacttcagactctccctcctctccagggctgagtactgtttccctgcaggcctagagcacattctgtttctccgctagtccgtgctgtcaccctcggctgttgtgaacactgctgctgtgaacacgggtgtgcacggcgcctgttttccattctgtccagtctcgtggtcacaggcgctcccaggccctcctgtccatctgtttggcgtcacttttaggctggaatggaagcccccaccgctgcactccagcctgggtgacagaatgagaccctgtctccaacaaaaccagaaccagtatatttggcacaaaatgcccttacgtcacttggcgggggggggatgtaggaataaagtgactcttccctgtcgatgtagaccatttgggcatccggcaaacagagccttcccttgacagaacagatgccccacctttctggtggccaggggacaggctgcctctcctttcccgcccgcccatcagctaagtgcctgtcttccaggatggtaaccaggctgtgccgtaggaggccaggtggcagtggccttgggctgtgtcaccagtctctagcctgaccacaaagggagcggccctgggggaggtgcagctgggggacaggttccaccgtgggagtcagaaaacttggtggttccccacacaccatggcattaactctcttgttttaaagaaacatactgcatatcataaggatctctgtctgtgagtcagcgaattgcacgtgcacgtattcatcatgtggcgcttttccctctgcatgtcccatctttggggacgtggtggagcgcctgtcgggtgtggcgggaacacgtgtgctgacctggccatgtctgcttagatctgcagcctcatgagagggggcattgctgagcgagggggcgtccgtgtgggccaccgcatcatcgagatcaacgggcagagcgtggtggccacagcccacgagaagatagtccaagctctgtccaactcggtcggagaggtaaggagggactttgagtgtgcctctgcatgccggttcccacgtgctcccgcctgccctccatgagcctcccccgctccagaggacacagggcatctgaaggtcagccaggctgtgtctcccatcggggctgctgtgacaagggtgaatggagcggcaggtgatgcggagccatcccggtctggctctaactgagcaaccgggagggcacaggctgctgggggtgctccctggacactacttttgggactggacctgtatgtccagttcagaagctctgcagggcacacagctctggccaccctggcaggcttgcctctctgcccttgctggccatcccctcccacagccaggctgcttgccctgtcccacttcactggctgaaccccccacagtccagttctttctggcatcgcttccacggcagtgtgaggatggtgtgggggaggtgcaggttttcctccagagctcacaaggaggcaggatcattgggaggggggatggtgctggggaggtggcacatacaccgggggaggcctggccagtgcgcagcgggtgtgcgtgtgtgtgtgtgtgtagtgtgagcgagtgtgggtgtgtgcatgtggatgtgtgagagcatgggtgtgtgtgggatgtgatgtatgagtgtgggtaagtgtgggtaggtgtgggaaatgagtgtgtgcgtgcacgtgggtgtataggggtgcatgagtggatgggtgtgggtgtgtggctgtgtgaatgtacctgagtgtgcgtgtggaggagtgtgtgtgtgtgggtgagtgtatgcggatgtacgtgtgtgtgtgagagcatggggtgtgtaggagtgcgagtgtgggtgtgtgcaggggtgtgtggctgtgggtgtgtgtgagcatggggtgtcaagcatgagtgtgtatgtgtgcacggctgtggctgtgggtctgtgagtgggtgtgaggcatggggtgtgaggagagtgtgagtgggtgtgtctgtgtgtgtgtaggggtgtgtgaaggggtgttcagcacaaaggggctgcaggctctctgggaagcgtggtggccgcacgaggcgggaggctgagagctgaggagcccggcctacagaggggcccgctggggaccgggcagggaatttgggtctggggacagcagcagcaggccgggccgtctgtggtgctccccctggtggctctgtgaggctgagtgcgtggcgaccatccttgcagcctgtgggtgggcgggtgggtggaggggtctctagttcctgttcttcggatgaggtctccaggagccacatcgggacactggtattttgtgcactgcagggtcggctgggagctgggaggcctgttttccctggactggtgggggcaggggtctggctcaggaggaggaggggccaggcggacaccagcctccctttgatggcttcaaagaaaggaaaagccagtgttcccaagtagatgctttgaagcggccgcccccacggccagcagccccacacctgtgaggaaatccacccgtggaggagcgggcgggagaacggggaagaggcaggaggcggccggggcgttggaatcctttcagccctgccgaggttatggtgcctgtttccagcagctctgagcccacgcggaacatgagtcgctgataaacaaggcttgcagttgcgaggggcctcggggtgggtttctggttgaggaacgccggggaatggctgatggaggaagcccctgccgggagcaggagcagcggaaacctacatcggccacacagatcccggcgggggagggagggcaacgctcagaagcagagctgcgcgatgtgcctttctgggctgctcagcccagggcccgagacctgcttgcctgaggaggggcagatgcacggcggctgcaccccgtggggaggccagcatgcctgcggcagctgaccctggcagtgcgagggccccccatccggaggccgcagcctagcacagtcccgggcaggacaggggagagcgtcgtgctcaggagaggagaagtgggcagtagagctccctttccgttcttgaagcagacgtttagagtctgctccttcccagtgtccgcaaagaaggattacaaggcgcgccacccacacggttggtctccctggggcggtctgaggccttgcttgtatacccagctcctttggagtcagggctcgaggccaggccccaaagggtcatttgctcaccgatccccaaaggctaagaacttgaggtgccctgggccccagcgagcctgttcccagcccccagcacactttcctggcccgtgtgtgttttgtaagaaggggtgtaggccgggcgcggtggctcaggcctgtaatcccagcactttgggaggccgaggcgggcgtatcacgaggtcgggagattgagaccatcctggctaacacggtgaaaccccgtctctgctaaaaaatacaaaaaaattcgctgggtgtggtggcgggcacctgtaatcccagctactgaggaggctgaggcaggagaatgacatgaacccggggggcagagcttgcagtgagccgagattgcaccactgcactccagcctgggcgacagagcaagactccgtctcaaaaaaaaaaaaaaaagaaggggtgcgtgtgtcttcccccattgagctcctcctcagtgaagcagagtgcatccctcgcagtttctgccgaggcctggccacccccagccagccccagtggatgggcaaactgttgtcaccactagaagtccaatttctcacccctcgggtgtcagctggactggaagcaaaactagcactcaactgtattgactcctctggagccaggggtggggacctggagtctcagtctgctgcatctggaaggcatcataagtgtccccaggcctgggcaggctggccttcctccttcactctaggagatgggcatttgaagcagaactctggggggtttgcctctgtcctttgctttcacctgattgtgggaggggaggtgggagggcagcggctcagcctcctgtttctgtccgcagatccacatgaagaccatgcccgccgccatgttcaggctcctcacgggtcaggagaccccgctgtacatctaggccaccccagcctggccacgcagccaggacaccgggcagggccgcccgggcccagaggagctgggagccgggccgcagacttgaccccgacgccacagcccagccacggacgctggctccccaaagggtgtgccctcaccacccacttgatttttttcattttgccaaaaaggggtatgtctttatcaaaggagagtcacagaacaaatgtttgtttgtaaagcgttccaagtattttgccacgttctggactgtcttctccctgcacaagccagggtgtgtctcggtagctgtgcgtggtgtggagtgtgtgtctttcctccctgaagctgtgcggagcgaactggcgcctccgagggacgcggctcccggggcagggcagccgtcacccctgcctcccgcccccttggctgggacgtctggggtcctgtggggcccccacaatggtcccaaacagctgcctctgccactgactgcagggacacgggcagcctggctcccaggacacgacttgtaatgaaagtttggggacatgtgattgattgattgattgtaaataaaggatgatggccacaacatgaaaactccatatttatttagatgctattattactgtttggacttttattttggcaggcttttttccagactctagggttttccaatgtgactaatgaccacacctgcctctcccgtcgtctcttctgggcaccctcccacccggctgcatacccgggcagggctcccacagagacaaggagggcacaggtgtctgccccctctttaaaatcgatctacacacatccacgcacatgcgaccccgaggaaacgaaacccactctagaaaacgcgaccttggccgcacctaaagcagccagccgtgagtgcagaccccttggccagcgtggcgcagtggccctgagcagtagtggcatgtgtgtagatcaagtcggatctagtccagctcggttcattagcgatccatgtaatctgacgtcatcttgtctcgaagtctctttttttggcccaggccttgaagaatacactgtgacttaagaagccttaccacgcagtaactaaagctttaggatgactgtattcgaggagtgccgtgtgttgcatgcagctacccgtaggaagacttcgcgcatatcactaataaacctgaagtcgtgatgaaaagccgtgtgtgtgactggtctgttacctcagcggcgggtgcccgcctgtcctttcattcacagcttggatgcggctctgcaaattcactatgcggtggcagccacagctgctctgtgctcctcctggatcctgaaccttggaagctgtcactaatgagttcggtgggtgggtgctctgggcaccaggtgtcagctgggcaacgccccgctgcaactggaggtgccagcaatgctaccaggtcacggggtcagcgccaggttcttgacccacttgccccagcagggagacacgtccgcagagcactcactaatggaatgagggagccagggagccttgggcttcttcagatttcaacgtaaatggcccctgggaaaggtgtgcatgcgtgtgcgtgtgtaaaagccggaccgcccatcccagcaccctgtctgcacctgtgggtcctttgcagcctgtctagagtgacaattctggcagctctgccagcacttacctttcttcatggccaccgttctggtgtcacctggtgtgggaaagccaggtagcaagcacgggctttgttcagaggcggtggcctggggtccagctgggttaggctgtgggtcttggatgggcaggagccctcctctctggcctgcccacagcagcgtgagctccttgctgtgggcactgaccaccttcacggcccaggattcttggggaactgcagagtaaggagaagacttactctcacctagccgcccagagggtgtgggccaagggcttgctccagcatgaccttggccatcaggggcatataaaagagacggcctttcaaggcgcacaccagctttgtgcctccctcttcccagaaagtatacatggtagaggcaaagaaagctgttccataggagactgtcacagagagctgcgtatatgccgaaatgtatatgcactcgctctgaatgaatatgcttaagaatgatgagttcatgtcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaattaaaaataaataaataaataaataaaataaaataaaataataaaataattcacaattctagcaaaaaaaaaaaaaaaaaaaaaaagaatgaaaagcaaatacaattctcgacgtggccaacaaacaagaatgccagggatggccacatccttggggaatgaagagaaatgtcgcctgagtcaaagctggagggaacgggattccactcaggaggccaagggggacattcctgccgtgcccaggacaaggcggggaagcaggtcccggggagagagccctggctagctgaggacatgcaggcaggactcccaccaaatcatacacatctttaaaaaacctgtatttaaggaaacatctgagccatggcctgcattcctcccagcagcccttggaggccatgtccatggaggggctgccatggccagcgtggacgggcgtgggtgtgtccaggccctggccctccccactctgccccggagttgaccctctccggaaggcttctggaagcacagctgagtggcatgggtatcccaggctccccggctggctactgcaaggtcctctcaggaccctgcccctggccactggggtacacagcctctcagcctgcctctgtcccagttagacctcagagacacagaggccagaaatacttctttttattaaaacacggatcattattaaaacaccttgaggtacattaaataaatacagcctttccagttgtacagacaggtctctggtggcttgaaaacaatttcctataaattctgccttagcagcctctgagagtcagcatgggtggggagaagcatgtgtgtgtagcgagctttctgtggcctggtgtgttacaagcatttaatgtggatcctcatctccagccaagggagacctgaagtccttgcggatgatgctcccccttctgcgatcttgcttgccatagagttggggtccatgttctccccactcagcaaccttgtggcccccaggctggggtcaacggtggtgtcacagcaggtgccaaccccctttgggtctcaggggagggcaggggatgcccggggcccagctgagttggagaaggagcgtgtcacccccaaagcagccacagttggcccatttcagatcccagatggaacatgattggagcgggggaaagacgcatagggaggggaagcagccagctttctcctgggctgtgagctgacgtgcagcccggggcctgggctcttgctgctggtacccggatgccgtggagccggggccaaggggaccacagcttctgggtcaagttgccagcacattccctagtctaccagcacctctctcttctggggaccttcccaggaagcccagaacctggaccctcctagagtccatgagtggccctgagcagcggggctgatgggggcaccccaccccgtccctgactgcctcatttcgaaggggcagaaggttccagcccagcggcatcaagttgggtacagtttccgtatccacaaaacagagctgccaccagcgcaaacccagagctgggtgaaggtggggtgcaggtgaggggcctacagggaggcactgctggggcagcagccccattggccattgggaccgggccctgctgcagagaagggaaggatgctgagcagcaggctgagggggtccagtaggcctctgccccggctgcatgaggagaacaccccagagaccgagtccactgggtggctggtggtcttggcctcgctggaattgcagccatgtctgaggactgcagctctagcccacccaagggctcagcccagggacaatgctgtgtgaacccccaagccctagtgtggacccccccaagcaggtgaaacccctgcggcgtggccccagcgcacctcagagacagtggagattcagaggccagggcgtcaggcgtggctgaagctcggctccagggcggccattctgaaaatccaccaattaatttcacctgcaaagggacttgccttgagggaattcaaaagcccccacttgaggaaaattagagatttcctgttttatagtctgaataaagtgctcaaaaattcatctctagtacgtctctcctgcaaaagtgcaggttgtcatcaaaaggcctggcttatgtgttttcagctctctaaagcaatcgaagccttttcagccgaccacagctgaaggagtcccacaccgcagcccccagggcagggataaaggactggaggaaggctctgggcacctggattggaacctcacccccttcccagcttccagccacacagaagctccccagcacactggccacagtggcattagggaattgggggagctcaaggacaagccccacaaagccgagggaacagcagcgtgagccccctgccctggcacccaggagtggaagacaccctctggtccccctgcgcccccatgccaggctcatgggctctctggggagaccttggcctctaggctgttttgttcaccgcagggcccacccaacgcagctcaggggctgtggctgctagtggccctgaacaggcatttccatcactgcacaaagttctcgtggatggcgctgttccacggccattgttgggagcagctgccactgatgccaccagaaaacaaggggatgggggctaagaaagtccaaggtccccaggctgtccccaagctgggcgtgtctgcttctccataagcagcacgttgggtgtctgcttcccttctcgtgtgggtttgtaagtggtttatgatcctcctgcgcaggtgtgtctgctgccgcatgcccggggaaaggtcagctctgggtcaaagggacctgctttatcaggaggggctacttctcagagaaaccggcctctctcctgcagaactgtgacccgctgagctcaatcaagtgagctcagacacaaaggagctgggaatcggcacttgttgttacggatcacacaactgctccagggacaggatgggagcctggagaaagggggcccaagaggagggggggaaggcaccccacggagggaggccgagctcaaggcccaggagatggtgggttcctccaacccccgcaacaccggcctgttccctggggggggccgggctatggcagaggcccgcactgcacatttgtttgcacaatagccctgtggacagaaagttgggcccaggctgccatctgtgctaacactacctatttcctttcacaggaaataggccagagcgtgatgaacgcctaatgatagagccatcgagccacatgagaaaatgtttcatgactcgatgtcaccctctgtccactgaacactaagttaaatgggggatgggagactcctgctttggaaggccctgattttggagatactttgagtctttaggtgacgtaagtgtcgcctgttgctgtattcacatttgtgcaacactgctcagttcaaggtgctgcacgccagataaaaccagagagttcactgtggacgtgaaagtcatctttccgaattactgggctaggcaggaaatgcaatccccaaagagacactgctcggctcccctcgagagagggggtaacagttccctgcccacaccgcccccagatcatcctgggtgtcccccccacatttatcctccgccaagctgggcctgaaggcctctttgtcaggcatgatggcttctgccaagaacatctgtggcgccaggcgttggtgtccacggtcagaaatgtggctccttcatacctggtccagaacgtcagcgccgaagacggcctcctcctcgaggcgctcctcgttggtgacagccaagcgcatggcacccaccatgtgctgtgcctcggtggggagggcacagtgtgagtgttccaaaaacttggccaccaaaaccctggcatccgcataggccttgctgtccactaaagagcgtggccgctctttggaggtcgctgggaagggctctggtgttggccgttggtcagttttccaggtatctgggtcccccgctggtgaaagctgggcccgacaggcagccgtggcagagcgagacatggaagctaaaaatcaagggcaaaagtgcagttcaaaactcactgaaataagaagttaactcaaaagcaaagaaaagcctgctcgggaggagcctcctgctggggtttctgtgttcctggggctggcgctctgggcatgccctgctgtccccatccctcctccccttctcaaccccaaactgaactagtgtcaacctccaggggctgcagcctccaggagcgaaggcctggggggaagggccaccacagcaggcagcgacccacttctgccctctgctagaatcccaagggcacaggggctggtccttcccagtcttctcgcctccacgacctttgcccctttgggtctgatctcttgctggggcagaatcatggcatctagagacagggtctgccttaagaccagaactgggggtggcagagggaacatgagaccgccccccccatcatgccaggtgcaggcagccaccactcagtgccctgctccactgcctgccaggccagaggctggggacctggctccagctccccacagagctgacagcctctctgcatgacccacaggctggacactgggctgagggtccctgtaagacggccagctccgggctgtcagtggcgagggacgccaacaaggaccagcgaaggcccggcttgcccagcctgagcttcacgccacacaaagttggaacattctgggtcgtctgttctggtgtcttgtttggtggcaactggaaagcctagcaattaaacatgagaaattaagaaactcccaggtggggcccatctaccccagatgaaatctcataaagtgggctgagcagtcacaggtgtgttaaattagtgctagccctggatataagtgcaccgagagacaaaggaagagaaaggccctcaaagccagacagtgggcagcccccattcccgggggtggggtgaggagctgcatttggaaacaatgtagccaaggacccaccaacacccgccccacctcccagcaggcgcagtcaaagcgctttagaaaagaagcgtctcaccgctcccaggcacagcctcagacagtcccgcttccaggtcctggctacacgacggcctgtgtgaagaggcatcgccttaaccagaaggagaattcagtgaacacatgaaaggaaaaaggaattcctgagaaagctatcataacccgcctgtgactaagacattttagatggcgagcaagcaggagaagcctgctgagctgacacccaccgagcggcagatcagacaggaaccgccctgcagctggccaggcctgccgtgggtcaagtggtgtcccaggtcccaccctgacacagtgcaatgggccagtggctcaaagaaagcccagcacccttcatgggaattcccaccctcacctgaagggctccaggcaccctggaaggcatgtgcctgcggcgtgcacatcagcctagccaagaggggacagaggcgtcaggcgggtgtgtgggtgccgaggtgtgaatttcactgagagggacaggcccaacaaagccatcagggggccacagagtggacccatgagcccctccaagtacagggcatcctcctccaaacctcagtgagtgaatgtgagcatggtggagagaggttccggagctcaagaaaccagcagaggggggtgtttcagaaggtttgacgggactctctccctgtgagctggcaatgggatgcaggaaggaggaatacagagatgaccgcagccagggagtccacatgtgccaaacctggtatttccaccaggagggtacctccaggcaactggccactgcgggctctggttcctttcagggactcggttccgggctccagtagagatcagctgggcaagaccatcgaggggagactgagccaggacccactgcgccctcttcagggttcctgcacttccacttcatgaaaagtccccacagcaatggcatggaggtcaaaggcccaccaatctttattggcagaaactgtgcctcctctcaaaagacagtgatgaggactgggtgtgagttctccagcgccgggggtgcccaagactcccggggagctactgtgaaatgcaaattcctgcgctgctggccacagggacctggtgccaggtcctaggctccagggcactgcccgcagacacagtcgcatggggcgatttttgaaagctctgggctgtgtggagagccaagctgcctgggaaatgctgctgaaaacgcacctgtgtctgcgtggggcggctccagctgatgacacccccatgcccagagctatcgttgggggtcatctgtcctgtgccagactctaggccttttctgggccctggagcacgtgtgcagcacttatagctaatgtcctggactgggccccgggccccttgaatccttcctcccctgccagagtgacaagcctggtggggtgcagaggggcccacaggctgctccccacccacccctggctcaggggccatcaagaccacattcccagtgtggccccagacaggatctgcagggccgggcctccactctcaggggtcactgagacctgcagcatccaaggaaagctggccacactctggggacatgggtgagcctggccaacctacctgccatgctagatgtgcacaaggtggggtcgctggtggagcgggacacacgcccgggacctggctgcacctgtgagcccatgccaggatcctctggagacacatggccagggggaagggcaggttcggagggtgctggggcgcccacagggccatcgggggatgggctggaacctggcgtagcagtgccctcggacaccaggaggcttgtgctgtcagctggtactgcaagagaagggacatggcattagagtgggcggccgcaggggacgctggcgtgggacaggcctgcccctcaaactccagacctagatgaactctgaaaccctgggggtgcggaaacactggataagattgacaaatgctgctttatgctgttgaaagttgggggcaccagatgagctcccagaaatcattccaggaatggcatggttcgggggcttagacccttcacactacacaagagactaaaagtcagaaatcagacactttggtcacaagacgctttggtctgggtgaacagggccagtgcaggggtacacagcagccccaagggacatcaaggcatccccaccaggtcgcggcaggccagatctcaggcccgcccttgcaggggtgcagccccgggcctggagtgcagccagacagggtggtgcaggcaggtgggataaactccgcccaccagacactggccttggctctcagggtgtggacgccacgccagcagcagcagcagccttgccctgggaacaagcggggaatgcagactctcagctggaccccagacccatggaagcagagactctggcgctgggcccagccaccggggttgaagcgagccctccagggaattctgatgccctccaaactgtaagaactgctggtctggaccgggatgctggtcagggctgggctcttgccgggaaccactctacgggggctggatcggagtctgttttaataccatctccacggggtgtgcatgcatgtgacagtgtgataagctgctcctgcactctcccctcccatcaccaggtgccctcagagccccctcctggcgccacagtggagttgcctgcatgggggacacttcatagatcacagaagcctggactcctccaggcgtgggggctttgggtctgttcctgccatccctttctgtttttccctgcgtctgtgagcctgcccatgggcaacaggcttttcaggccacctcccacttcatccttcctgtccgtctgtgaggcagccccaggttacccccaccctacagctgcagaaatgggcttagacagggaagggttgagggtcacacagccaccaaggtggtcctctactcaggagagtcctgacccctgtaccccagcagaagcctcggtgctggaagctctgctggtccctgggtcagctgtagagttcaccgcccaggtcccaggagggaggaagatccagccctgctgaattctgggtgaggagcacccctgtctatttccacctgccctgagatgggaaacaggaaggggctcaggtagcaccagcccccttcagcccaaaccctggaatgctgcaggtgtggccgccctgtgacagtgactgagatacactgtaccctgggttggccgtgggaaagtcactgaataccttcttgaacagcctctgatggcttggagtgaccaaaggaaggaaaagattgcttccaaatcccacgactgcaaagatgctgcgctctacaacccccggtggcctcagaaagatggctccttcctgtttctcttagatgctgagtgagtgttcagcaggggacagagcgccctggggcgatcatcctggccctctgtgggatcacatgagttatctaactttgttctccaaataagccagcccatgtgacccctcgcaggggcctcaagacggtggctctctggctcacttggcctccgtgccctttctccctctgctgctaagggcccttctgctttcctggagccttagaccacctcccccgccccggctctgcacgcgacacccaccctctgtgtctggggatttgacccttgcacacgtgtccttcaatgccctcaaggacatgacttccagcctgcaccctcctgccagccgcccagcccagccaccttcttcagagggaggtgccgtgtggacatttgcccggtaggtacaactttggctctggaaaggggaccctagatggagtcgtgctcttcttcaaatccatatccctcaagtgagaaagtggggcagaggaagacaaggtctccccggagagcgcaggagatctcctgcatatgctgactgtagtggatgcagacacaggaagaaatgtggggatatacagggtatttaatgggaaagactgctgcaaactccaccctcttaaagagtaagaaatggagggaggaggaggaaaaagagaagagaagagaagagaataggacgaggacgaaaaagagacacccttgaaaacaggaacaccccacttcaggagctgaaagaggtaagcttacctggagtgctgaagccagcactggtgtttgggtccccggagctggactcggccacctgctgacctatacttgtaacctacagtaagaaacagaaagcgtcaaggcggctggtccgtgggaacgcagcacagcagcctccagtagtgtaggcgcttaaacttgtctcctggtgggaagcgctgagagacgttcatccacacctccactcttctcccctacatttatgaggtggggtgtgagggttcaagttgcccttgccaaggccaaagtctagttttcttttttctttttttgagacggagtcttgctctgtcacccaggctggagtgcaatggcacgatctcagctcactgcaacatccgctgcccggattcaagcgattctcctgcttcagcctcctgagtagctgggattacaggtgtccaccaccgtgcccagctagttttttgtatttttagtagagatggggttttgccatcttggccaggctggtctcaaactcctgacctcaggcgatccgcctgctttggcctcccaaagtgctgggattacaaggtgtgagccaccgcccctggccgaaagcctatttttctgaacttttgcaatcagagagcctggcagggccacagagccacctgagcctacgagttgcacagtcatcgagcttttgtggctttcgatttctttttcttttctttatttatacattttagagacaaggtctcgctccatggcccaggctggagtccagtggtgcaatcatagctcactgcagactcgaactcctggggttaagcgatcctcaggcctcagccttctgagtagctgggattataggcatgagctaccacgccctgcttttttcagctttcttcttggatatactctgattccgcctggagaggcctcagaataaggggaaggctatacctcctctgctctctgccccatcttcattttgcccattctgcgtgggccatggtttccacctcagagggcatcagggcctcccggatgcgatgtttggatgtgatgccagctacacacatgttgcatgagcacccccatgcaccccatgctacctcagaaaacaattttttgaatccctgtgttatttcagaattgctttggggatacacttgcaaataatgagctccagaggagactgggaaggtgaggggggctcctgcgacttgctctgattccagctcaggtaattacatttctgcctcccttatctcccgccacttcaatcagatagctggtctccttcatctctcctcttcaaccaggctgacaccagggcgggggctggggctgcagccttcccacccacacaaagggtgtgagctgcccccacagcgtggggctcgagaggtggttccgagacaaagagaagacggagagctgcccaagtgcgtcctttgatctcactaagatgctttcgcataatacggtccatactatttttcttccttagccctctcattctgctgggagggaatcggtgagggagaattcaccccaccatcagcacccacctgctttttcactgaagtcattatgtgccaataaccagtcctggaaatctctgtccagaaccttccactgaatcacaaagagcgaacaatgtcctaacggtttgtttcatcctgtgtctcccctcccgtatctaaccctctctcggacttgcttttcttttggatcgtagacgggtggttaacttagaactccgctgtctaaaagaaaatcttctggtaataaagaaatataaataaaacaagagaaagaaaatatacagtgggacaaggtcaggaggaaactggattcacttcatgttgtgcagaagcatcattcacttccttctggctcccggtcagatttggtttccagaggaggcagctcctgggagcctatctatcacctctcgcaagcagagtgtcaagagtttaatttaaatgtggcccttccctgatgtcagaagccaccttgccacgctaagccatggggaaaatagcacttcctttcatacagcatttttgatgaactataacagcagtagaaaagggtggggaagaaatatatttgtggcatagaatttaagttgaaatttgagttcagtgaggaagctcataaacacagctccttacagaaggagagcggggagagggctgttgacaggagacgctgtgggaatcacttcacctgggtcttactggtttgcagatgtgctattctgaacagtcatcgtaactggaaaataagttggcttttcaacaaataattcaaattgtatgaagctaagacacttgcatggaaattctgccccattctgtagtttcccactcctgggtgaggccaaccattagaaacagatttatgaagagctcttcgtttggggcaattccagcgattatggaaaatgtgagttaaaattttaggctggtggctcaaggcaaactttgaagacactttgctaacagattttatgtggatcgtaagtgtcaggacctggtgctgctcctggactctgctggtccctctcccttctcacaactccttgtctcgcactcaggttcccttccacctggcatgctgccaccaaattaaactcctaaagcatcactgggtcgcacccaagacgccaaactcctcaagggcacttctacagtttgacatccaaagccataaaatatctgcccaaatgatttcagccctggggtgctgaagctcccacagccaggctccaggctgtcctgccatgcgccttagctggtgctgtgaccttcacctgcaccacctccccctccttcacacaccccagcccgacaagcccccccatatcacctccccctctacacgcaccccagcccacccagatcaccaggcccgattcctctgcagaagcctcaaaggagttcgtgtctgtccggtctccatgtgagagtgcgagagtgccacgacagggggattctgtcctacatcctctggagggccaccgtcgtcagtggcccctgaaccatacgcttgccacccagacaagaagatcaaactggtaatttctcaatcactttcctgctatcaaaagaaactcactccttgaacactggctgaagagtacagcctcaaaccacaggaaagagaatggcatctgacctaagccggaagggaagtgtgcacggcccgtcacccatgcgagtgctcacggagcccaccctcgtggaggccgccccctcttgggttaaacctcttccccagcacaccccctgccccgccccagagtcagctcctccccgacagagcccgccttctgcagcctcctctctttatccaaactgaggccgagggcactttctacgccatttgtcctaacaaggaggagcactactgaccctgcctcgcccgggctgcggggtcgtgctgtgaaggggtgctccttgctgtctagtcagaggggccttgctgcctggggaggggacagctggtggtgcagctggcggcacggccttccctctgtggacggtaatgggtttctttgacttccagactcccagacacggccgtgaattgaaaagtgctcccaggccatggggtcaaagacagtgggcccgagggctctagcggccccttcatcaccagatgctgccctgctgccaggcgggcgcccagggacaggccctgcaggcggtcgtgctgtgcccctgccagcactgggagctgggggtctccgagccaacacatgctaattcgagatcagcctctgacctttcagctgttctcaccgcagttctgagaaagagatctcaactgagagaattccccagagttctggagaagggtgtcgcattggtttcagaaccagccagatcccttccaatatattctattcttcagagaaaacagtaaaactgtgaacacaacaggaacccattccttccgggggccgctgtgaggtcagacattgaatggcacacccaggtccagaagctacttccagcaggcagggccctcgggaagccagggtctgggctccacggacaggggttcctgtcgtcaggaggcagaggggtccaaggggcagggagaaccgggaagcaggctcagagccagtcccagtgcagagccggaattgtgatggcagcaggcagggtcactgagcagaggcggtgaaggggacagagctgcccccgcgccacaaggcagccatggggaaccacacacccctgccgccttcaggggtttccgggtccatctgccgccctgcccggtgcccctgctggctacagcatggagcttcccattgcaccctcggtcagcctcccctctgccttcccaggggcttccctcacggagggccctgtcctgggcctgccatccccagtatctaggtccttccacatctgcctggtaacctcctcaaggtcctagatccacactcccctctacctaccatcccatcttctctcctctttaccaaacatcctgcgagagtgatctactcctgctctcaaagtgggagcagcagcagggctgaggcttttatacccccaacttcaataccccaattactgactcaggagccctgggggtgggcccagtcattaggatttgattatcaagttccccacagggacacccactggtgtctgaaaaccacagccacacctgcgctcccctgcgcacgtgccgtccactcctttacctggtgtggtccagccctgccctccatcgcatcaaagctgctctgccaaggccaccagcagcccctccatggtgcgccacgtggccctggatgttagcttctggacagcacctgacccattgctttcttccagaactgctggttttggcaaatccaggctcctgggagccctgcctagtgccctgtagcctgtcgtgtgtgggggtgcctttctcctgccacctgcaatggtgtcattctgtggggctccctctctcacatttcccaggccccagtgacagcggcagctaactctgatcactatgaactacagctcctgtcatctggtggacactcactcagaattcaacccaccacacccagacaggtcaacacccatgcacactcatccgagactctttacggacgaccttctgtttgggggatacgctgtgcctgtccttcttccctctgagcctttgcacaggctgttccctctctcaggagcccttccagccccactccctgcacctcgcatgcctgatgcccacccagcctgacctcccagaccttccatggacccccaaattgggcctgacatcatgacaggtgccccacagtgtactgggctccccttgcagtgctgatgacaactattatcacagccaactgtctccactgataacattgatttgaattatttttatcataaatggaaaactaaacaacattgggaaggcagaggtcccagctcagctttataaaaacacctaagaacatctccattactgccagttcaggaatgggatttcagggccatgcccacctcctgactaaaggattcctctccacaggcagctcccacacatctgcttctagcacccacagtaaaaagggggtcctggccggggctcagggggccactgtctgcagcctgcctggctgctccaggtgtttcagggtggctgcttggggactgtctgcttgtgtgaggatgtgctgggggctcacgggccagccggaagctgatctggcccaccacaagccaccctgaaggaggtccctgtggtatatatgactccccaggtgcggggcaccttacagcgtctgaatgcgctgtccatatatgactccacagggcacagagaagtcacatctcttcctgtcctaagaccaccctgcctgcaacggtgaccagtccttgtgggtgtgattgtcggaagggcttgtgagcttattcagccaacatggaaactgctcctccacccacagaagctcctcagggtcagcgctgccttggtcactggttgggacagggaccagcattgccacctggcttgcgtgcatgtgggctctcgggatctcaaagtgacagggagagcattgggggtgacatcaaaaggtctgaaccctgtgctagggtgtctttacaggagtcagcagacagcgagcagctggccaggcctgatctgatgcccggtaccagtgcctggccagtgatctgggtagagataaccatccggggctccacggctgctgagaagcccaaagcaggtgcagttctgggtgggcctggatgcttctggtcatgctgtcatctgctctcctctgcttgttgcttgggctcagaattggcttcagcccctacccccgcccctccctggtgaatctgcaagtctcccctgcccacgccctctgctccaactcactgctgtgttccccagccatgccccagtccccgaggcctccaggacctccttggccacctgtcacgggagttctctgcatttcctaaactggactgtcggcctctctagcaggattggggcaatgttcatggatgatatcctaaaatatgttttccagtcgtttgctttctctccctgtatttcagggacaccagtgagctgtcgatttggtctatttacataaccccatgttccttggagggtgggtccttggaagatcccttgcactatgggccacgtgacttttccagatgtccccatctctctgtcctggctagcagcattccacactgagtcatgacaacaacgatgatgaggaggaaacaataccccaaaagggtgactgacttgctgaattcagaacttcccatgttccaagtcctgttggctccattacggacaacatcccatttcgtcccataaccctggtactgttatgatcctcattttacagatgaggaaactgaggctccacgaacatactgcctgtcacgtgtcaggcaccatgaggctgcaggagtgcctggcatgcccagctcagagaaggctgaaaggacctggcaactgaggcacttccctggcctgaagcttcttggcctcagacaggaccagggatccagggctgctttctccccaccccagagggcggtgatggcagtgtgtgatcaagacaggccggggcgccctgggtactcggtccatggacccagctctgctcctgggggctctccccttgggtcaggagctgtcccaggtccttttacctggatcccagaccacctaccagcacaaagctcagacgcacctgggctgtgactcgtggctgcagaaatggaactggggatctaaggggaaaagcaccagcactgggttccccaggcccgggctggcgtctctgcaggtgccgctctctgagcctgtggcctcatctacagcacagggctgataagaccaacatcccacaggtttgctgaaaggcttcaagagagatgaatgcatccgggggcctcggcacagggcgctcatgagtgttcacctcacagccagctcggacctggcgcggtgtgaggtgccttccgagggcaggccgggacggtgtccctagcattcccacgggaactggctttgtctggggccccaggcctcacctggctggcagggggctggcccaccaccgcctcgtacggaggggggagctcagcaggatagagcaggccggggctattgatggccacgtcatacaaagtgccgaatggagacggagcaaagtccaggtggaggcccctgaaaagacagaatcatcacatcgtcattgcccgaaggaggaggcagaagtgctgacagctctcaaagccgccagagcaggggcggccagggcttcccctcttctaatacttcccatcattgtgaaatcaaagcttcagtcactgggcgatttgcacttttgttttttttttttttctggaacgacatcaacattttcaataaactctactgacctgtccattaaaattcaaataatcatacagctgattacatctttcattaaactgtacatgttacacaaatgactgcaacgtgaccgcagctttgcacgtcatgagaacttaaggcagcaacacctgtctgcctccggcttctttcgggttgcgttgcaaaggtgccacggggaacgctgtatgtctaagaccctctccttccactgcccctcctctgttctcaccgccatgcctgcaggaccactgcaactcccaccacccggacactgctgcccatcttagtggtttcgagatgggggcagccgcgggagaccaacctctgggcctcagtggacggtgtgcaggtgtactctggggggtaatagggtggaggcgggagtggggggatgaactcgtcgaaatccagggtctggtggagaacggtgccgtgaggagtcacgcaggtggggttggcaggatgtgacctctgcggaaggaactggaaaacagagacaaccacagagttatctgggacatcttgtgtggcttgtgtctcattaagctaattatacgagagctttaatgatcagtttggaatgcctgtaatttcaactgtcaagccatgactgctaagcacacactttaaaatgaaggcgccaggaggaacgcctcgtctcagaagtctcaaaacgctttgttgcccacgctgttatacagaatgcctctttttaaagaaaacatatggtctgggaagtctttcatgctgtccctaccactccaactggcccctctgatgacagtactcaaagactgcagacggaaggctgcctgacgtgcgtggtttaagacggcacttcggctgggtgtggtggctcatgcctgtaatcccagcactttgtgaggccgaggcgggtggatcacctgtgatcaggatttcgaaaccagcttggtcaacatggcgaaaccccgtctctactaaaaatacaaaaaattagctgggcgtagtggtgcatgcctgtaatcccagctacttgggaggctgaggcaggagaactgcttgaacccgggaggcggaggtggcagtgagccaagattgtgccattgcactccagcctaggcaacagactggagtgtttttgagactctgtctgaaaaaacaaacaaacaaagacggcatttctcaaagtgtgttcatgagaaaacactagaccctcccctcgaaatgtccccaccccaccccagaattcccgtggtcaatctgtgggaaatgccacatgctcccttcttggagtcctgcattgtgcattcgtgtgttaaaggctctgagaagggctgtgctgaagtacttatttagctgtttaacattttaacccagcatttctcaaatatttcataatgggcccctttggacacgtagtatctattaatattttgcagtctcaggatttcacacagtttgtaaaacactgctctgaggaaagagagacaacttcatgagttccagaacattctactggccaaccttgaacaccgagatgctgctttaatagtgaggtgaaatcactttaacaaaaatgaaacctgtttctgcctagttttccgtttctgaaggactaaccaacaaccaactgcttttctttccaccttcacatctctgctgcccagaggtcacctgtggcgtgagatgcctgggacattgctccagctccagtcaatgccgccctatgagtgtctacacggcaagaagatccatgctgcaaaagctctgggccaggggccctcctggcgcagggcaggtgaggtaaggagaggaagggtgagtgcgtgtgtgtctgtatgtgtgtgttgtgtgtgtgtgtgcatgtgcatgtgtatgtgcatgtgcatgtgtctgtgtatatatgtatgtgtgtgtttgtatgtatgtgtatgtgcatgtgtatatgtgtatgtgtatgtgcatgtagatgtgtgtgtctctgtgtgtatgtgtatgtgtgtgtatgcgtgtgtgtgtgtgtgtgtgtgtgttgaggggaagacagggacccagaatcaccctacacaagcaaggacagctccattagaaaacagtgaggtctccaagcactgtgtggggactgcgctccccaaagcattcatgaagaacgcatctgaacgggtcttgaaagattggtgggatttcatctagtgggcgctcagggagacactcaagccccagaacaggtgagccagggaaggatgtgtttaagaaaagcaaatagataaggctctggaagtcaattcttaattctggggcactggggagcctgtaagggtgttggagctggggagcagggggactggagctgcgtggtaggaggtgccttctggcagcaggggtagggtgggctggagctgacagaggccaggacgtgaagcacttttgcacgggtatgggtgaggtgacgattctgaatggggtcaagcgctgtgaaataagcatgctctaggttgacgaagaaaggctggtggccgtgtctaaaggtctaacacatcacaggaaaatggctcccgtgggcctcctaacacacggagcacactcctcgcctctctggctggaccgacccacggctgcgtgtgtttaattgtccgaaacagaggtgaatcatccgctgtgagcgggacgcatgtgcgtctgtggtcctccgccttggaggctgtcagtcctgatgcctgctgcacagagctgagaagcagggcgagggcaaatgccctcaggtctaatcaggaaatattttcaattagtctctatcagaaattagaaaaaatatcaatgacatacccaagcaaaactaatgacatgcagacaccaaaacactttccaattcaaggcaccattccaccaggaaggagaacaagcatttgaggaggggcagaggtgcaagggaccctctccgcaggtgcaagtgagcagaggctgccacacactggaggctatgtaaaggtcaaaggacgcggctgcatctgctccgggtcgcctttcggggacatgttggccccaccttcctggacccttttcccaggaatcctttgaccttgactcctcagcctccccagcgagaatcctgcaagtggcgcttgacgtctcccctctcttccccaccatcagtgtgtgtttaattaggtctgggtgtgtctcgcggcccagggtggccagctctgtcctctgctctgcaggctggggctggaggtctgcagactacgcttcccaggctgccgtgcctgggctgccggcaggctctgcctgtagggggtgccagagggcacctggccggcctgcggggcgaggagggagctgcgggtttcctgcgccttcccacctcctcccttctgttccccggctttgcgggctgagagctgccctccgcacttattccactctctgtaagctcagcaccctcttctgttccttcagccttccacacccaagtaacctgctccccgtaactgtgttgaaatcctaagggcaatttcttttcctgaccatctggggcacatctattttacccacctctgtacccgtctcacaatcgcacacagcgggtactcagtaaacttctgcagaggagacgggcagacgcctccttgcggggcaactccactcagcccctgtccacctcctcctcgcaggagcttctaacctgtgtgcctctctgccttgattttctgtctctgtaatttggtcgccatcctgctaccacagctgtttttaaatcaatctgatgaggtcactgcagttgaaaagactttaatgagaccctggctcactgaactccatctggtttccagcttcctaacccagcgcccccaaactccccgctctttgaacaaaccagctctaatccctactatcaaacacgtattgttccttcttcccagctccccacctccctttcacctggcgcctcccagtcaccttcaggaccagcggaaatgcctgtgaccctgaaaagccagtgggcagccacccctcccccatcccacccaagctccaggctctgcagcctcacctgcatgttgactgccaggtataaagctcaactctgcacctggaggtggagggcaaaaaaggggctgtgaacagtcccttctttcccaggtggctctgtttgccctgatctgtaactgtcttctctgatccatgtggtgacaaaggtacacctgtgtctggtgcccagctggggctcatgcacccgatgtgggcatcactagtgcccagggctgtccccgcacaacaggagtgaggatttgagaccccgctggagaagagcccctgctcagtctgctccggggagaggggatccgaactcaggtgtgtgctgtccaccttctcaggtgggtgcacgtggaagtgatggaggatgagaactaaggctacctggccttgggcagcttcccaaagcccacttaacacagagccccgaacatttcagtctatccacacagcccagagtctgggatctgagggagatcgtgaagaggtcaacctgcctgggaccgggagtcagaccgcaagtcagttgtctctgggccctgcctgggcactgagggcccacaggatgtgagcacatttctgatcctgtgagtctcagtccccttccctgagaagcaccattgctcacacagacccagacagcagtgctgtgtggctgaaaggaaggcttggatcattagtatgagctcatccagcccatgcctccatctcctgccatcgggaacaaggtggggcagggcaggcatcaggggtctgtggacaagggccggggatttgcagaaacaccgtggagctctgagctgcctgttcctccaggtcccagccgggtctgctcacctccctttatatttagtggtttcctgcccagcacccactctccctgctccctctaccaatgtccttgccacatcctggctcctgaagggagcacacacacctctgaatttttccagaaagactcagaattacagggaagggccttctccctctgccttccttagacttggtagaaacagcaggcttgttactaccgaagtttgctgaatcaacttcctcctggacaaccctgcagatgagctggagctcccgctctgcgctccagaccctggggagagcccgccctgcggccccctggtcctgccgccacccccaggtaggttccatgcccacccagggctccagggtgccttactgcacagggtgaggcctgtgttcattatgactgtaattgcataaggaaatagggatgcagacaggaagagctgctcgttctgtgaaaaccaagttgaatgctttggaaagactcaataaaggagggcagccaagcagaaaccgctgccaagtcaagtccaggcaaggcaggtctaagagcagagaagaatcataaaaatctagggaaggtctgtctcccctggctggcttcccctggctggctccactttagaggaactgaatctgaaaatcattgatggtgtgatttccacaaactttctgcaagaaatacacccagacaggacaacagacccataaccaaagggatgaccacagccccaaatgagatgactggttgacagatgctcattagcatatctgacgtcaaagaaaaacgattgtgtgtccacatcatttttatgattgtctgcattagctgtttggatgaagttcctggtctgatagataagtagcacctactgtccagagacaattctgtggagcccaggcctcaaggacctcaaggttactgtgggtccccagagtgccctctccagcaggtgcagccagtgctggggtgaggcggagagaagacactggtgaacttggtgatgctgtggctcccatggggtggtgtcgtgtccctgaccagccagcaccgcttaaccagctccatgggcaaacccacagttaccacgcgatggaaggcacagtgccccctctgcactgtctaaaggaggtcaactctgtagggcagacagctacctaaatgacaataatgaaagatgaagttaataagcgcatgcctaatggagatacatgtcatagtagatgatattcctgaggctgcagcagctggcgaggaagtaagtgaagaagaaaacaatgtatcagaaaagtggaagaatgagatgacatttaaaaacaaaaaaaaaatgacattacagacacttaaatgatcaaaaaccttttctgctaaatgatgtcaatcaaccacattgtatcatcagaatgtcttttgccacgatttccacacatattagagtagctcagcttcatcagttctgacaataggcagaacgctttgcttctcatggatacaagcatgcattatgctagttccatcggcagttaatgatcccaaattgctgatccacagaaataagatgggagtttcaggttctttggagacttgttcttgctattcctagattcccaccagcactggacacatagcaaagcccctgagataattgctgactaactgaatgaatgaatgagtgagcaaagaagtgaacagatcagtaaacacaaaactgggactcttcctgaaaaatggttacggctggaattttgatcaattgtgtaagttgtcagcacatcaatcacaatagaaatcacagcctgggtccttcctgctaacatggaggagcagggagaggggctgggaaagtggggctgagacccgcacagtggagcagagttgccaggctgcagggctgccttgggggcaaattgggaagaggtgctccttcctgtgggaggtcagggcatggctgtcatcccctcagcccagcacccctctgtagggcgcagcacaacagggcaccagagaagggccgtgggggctggagctgtggctcggggggcttcccacaggttctttctgagaaaagaaattagttgattgggaaagggtggccgaagggcttacacacacttgcccacagtgaccttcctccttaattatgctccctttataaattagtgcttctcacttggaaggtctcagatacaaataaacaccagaaatgaagagttagtacaaccaaagccacaactgaatgcaagaaatgaaaacccgctcagaacaaagaggccgacatacaggaaggtaaagaacacagaaacagcagtgagcagtaaagcttctataaaattaaatctaaaggggtcatgaagatgtgaagggatgctgtgatttaagggctaaggaggagtgacatagaaaagacatcccaaagagcttacactctaacacatttcgcctggaactaaatgactttaaaccaccgcaggaaaacccagaagctggccatggtgtgggaggaggagggaagtgacgcactccaaagaaatgacagggtaagaagaaagtcatgctgaggaaagcacaaaacaccaagacacacagatgccaagagacgccttcttctctgggactagtggttgcctggttaatgaataagaaagttatttaaagtggggagtttcacacacacatacacatgcaaacataatacatacatactgaacccattttactttaacttaaatcctgtatatgtggagaaattcatagaaagacacaaactaccaaaacagacttgagaagaatagaaaatgtgacaagagattgaattagtaataatacaactacccgcaaggaaaagtgcaggctcagatggcttcactggtgaactctatcaaatatttaaagaagggccgcgcatggtagctcatgcctatcatccaagcacttggggagcccaaggagagagggtcacttgagcctacgagttcgagaccagcctgggcatcatagagggaacctgtctctacaaaaaaattaaaaaattagctgggcatggtgacgtgtgcctgtagtctcagctacttgggaggctgaagtgggaggattgcttgagcccaggaggtagaggctgcagtgaaccatgatcgcacctctgcactccagctggggggacagagtgagaccttgtctcaggaaaaaacaaacaaaaaaaaacatttagccgggtgtggtggctcacacctgttatcccagcactctgggaggctgaggcggctggaccacctgaggtcaggagtccaagacaagcctgcccaacatggtgaaaccccatctctactaaaaataaaaaaaataaaaaaataaaaaattagccggatgtggtggcatacatctgtaatcccagctactaaggaggctgaggcaggagaatcacttgaacgtgggaggtggaggatgcagtcagctgagatcaagccactgcactccagtttgggtgacagagagactccatctcaaaaaaaatttaatgaataattaatacaaattcttcataacaatcttccaacaaacggaagaggaagaaacacttccaaactcttctattaatatgaaaaggattacttatcataaccaagtgggatttatctcgcaaatgcaaggttggcttaacatcagaaaaatcaatctgtgtaattcaacatattaatagaacagaggacaaaaaccctatggtcatctcaatagatgcagaaaaagcatttgacaaaatccaactttctttttgataaaaaagacccaacaggctggacacggtggctcatgcctgtaatcccagcactttgggaggccgaggtgggcagatcacgaggtcaggagattgagaccatcctggctaacacggtgaaaccccgtctctactaaaaatacaaaaaaattagccaggtgtggtggcgggcgcctgtagtcccaactattcaggaggctaaggcaggagaatggcgtgaacccgggaggcagagcttgcagtgagccgagattataccactgcactccagcctgggcgacagagcgagactccatctcaaaaaaaaaaaaaaaaaaaaaaacaaccaacaaactaggaatagaagggaacttcctgaatctgatcaacagcatctatgaaaaacccacagctaacatactacttaatggtgacagactggatgcttcccctagatacaagctaagaaagtccactctcactgcttctattcaacatcgtagtggaggttccagccagggcaatcaggaaagaagacaagatgaaagacatccagagtgaagtaaactgatttctatttgcaggtgacatgattttgcatatagaaagaatccagagaaaagcccaacaacaataaagctcaaaatgagttcagcatggtttcaggatatgagatcaatataaaaaatcatttgtatttctatatattagcaatgaatgatctgaaaatttaattaagatagtaattccatttatgatagcatcaagaagaataagatactcaggaataaatttaacaaaaaagcaaaacttgcacactgaaaaccgtgaatataactgaaagaaattaaagaacatctaaatgaatggaagggtacctcatgtccataggttggaggacttactattgttaagatgacaatattcctgaaactgatccacagattaaccacaatcctcatcaaaatcccgggtggattgtttgcagaagttgacaaactcaacctaaagttcatatgaaatcaaagggcacagaatatccaaaacaatgttcaaaaactacagaactggagggctcacacgtccacacgtcaaaacttactatgaggctacagcaatcgaaaccatgtggcactggcatcaggacagacataggtcaatggaatagaattgagagtccagaaataaacacgtatatctatggtcaattgagtctgactaatgttaccaagaccattcaacggggaaagattcattttttcaacaaatggtgttggaaacagaacaaagctggacccctacctcacacagtgtataacaatgaactcaaaatggtctaaacacctatgtgcaggccgggtgtggtggctcacgcctgtaatcccagcactttgggaggctaaggcaggctgatcacaaggtcaggagtttgagaccagcctggccaacgtggtgaaaccccgtctctactaaaaatacaaaaattacctggggtggtggcacacgcttgtaatctctgctactcgggaggctgaggcaggagaattgcttgaacctgggaggcagaggttgtggtgagccgagatcacaccactgcactccagcctgggtgacagagcaagactccatcttggggaaaaaaaaaaaccaaaaaaccctaagtgtaagagctaacagtaacactataaagctcttaggcattgctttcttagatgtgacaccagaagcacaaacaactaaagaaaaaagcagagaaactgaacttcatccaaattgaaacttttgtgcatcaagtgaaaagataacccacagggtgggagagaaatttacaaattatatatctgataagggggttgtgcctgaaatacagaaataacttttacaactcagtaataaaaagacaaataacccaattttaaaaataggcaaaaggtctgaaaaacatttctgtagggaaaatatacaaatagccacaagtgcatgaaagtatgttcaccatcattaattatcagggaaatgcaaatccaaaccacaatgaaataccacttcaccaccactacgatggttataattaaaagaaagatcataagtgttggcgtggatgtgaagaaactggaaccaaaatgaaataccacttcaccaccatgatggttataattaaaagaaagatcataagtgttggcgtggatgtgaagaaactggaaccaaaatgaaataccacttcaccaccatgatggttataattaaaagaaagatcataagtgttggcgtggatgtgaagaaactggaaccacaatgaaataccacttcaccaccactaagatggttacaattaaaagaaagatcataaatgttggagtggatgtgaagaaactggaaccctcatggtctcacggtgggaatgtaaaatggcacagctgctttggaaaacaatcttgcagttcctcaaaaacagaatcatccttatgacccagcaattcccctccaaggtatatactcaagataaattaaaacatatgttgacacaaaaacttgtacaaggatgttcataacagcattattaataacagccaagaaggcaaacagcccatatgaacatcaactgatgaataagcaaaatgtagtatactgatacaacaggatatactgttgagccgtaaaaaagaatgaaatgttggtacatgtagaaacatgaatgaaccttgaaaacatcatgctaaatgaaagaagccagacacaaacggccacatgttgtatcattcaatttatatggaacatgcagaacaggcaaatccatggatacagaaagtagattagtggtttcctagggctgagaggtgggaaggaaatagggtgactgctaaaggctatagggtctctcttggggataataaaaatgttctaaaatggattgtggtgaaggttgtacaactctgtgaagatattaaaaccgctgaattttaaatggaggaattgtatgataggtgaattgtatctcaagacagctgttacccgatcccccatctcacagatccctggtaaaagaaaaaaaccatttataaagtgtccctctgaatccacaaggaattgcttccagaacctcctctgccactggatactaaaatcggtggagggtgaagtcttttacataaaataatgttgtatgtggacataacctacacacatcctcctgtatactttgaatcatctctagaatacttctaacacctaatacaatataaatgctatggaaatagttgttatactgtattgttttttatttatatttttgttgttgttttgttatttttattgtgttttttccttgaatagtgtcgatccacggttggctcagtgggggctgactgtacatacatggactgacctttttctgcctgagtaaagccttttctgagagtcagtctgctgtgtggagtgcctcgtggtctttcctgcataagctgcatccataagacatgaatctaacaacccttttctgtgtttttaaagtggggctagagctgaaaggcacttgtcaagcaatgtgtatgtggactccctccagatttttttttaatttttttttttttttaagtctcaatctcgctctgtcgcccaggctgtagtgcaatggcacagtcttggctcactgcaacctccgcctcccaggttcaagccaatttcctgcctcagcctcccgagtagctgggattatcggcatgtgccaccatgcccggctaatttttgtatttttagtagagacggggtttcaccatgttgaccagggtggtcttgaactcctgacctcaggtgatctgccggcctcccaaagtgctgggattacaagcgtgagccaccaggcccggctcctctagatttttatcagcatttatcgcaaccgccatagttgtctcacttgcatctaatggacagcaatacattcagcagcaccccctttcaccgaacctttccaaagaactcgactgtgctgtaccagaaacaattatctttctgcactcatatttcatggctttacatagtactagaatatgtaattacaacaaatatcactggcataaactagttaggaatagctacaactgtcccttggaaagctcatggcccagcttcctggagcagaaatggcgcaggggtgaactgcggaagctactggtagggaatggttcgcacagccagcctggctcaagcctcggcccacatggcaagagccgacctccatgtggccaccacgttccttcaaatcccattcccacagatgagcggactcatcccatcagcagctctgtgaggacagcagggcacacgcttcatctttagagccgaggaaacggggtcccacaggcagtgatgtgcccaagattgtgccagtcccatagggcgccatggccaccctctgaatccacagggaagtgtggattcacccaccaccagctctcttttgcctcgcccatgactctcaagcccggcagcagagccgggggtctcatcacgagagcagagccttgggctcccgcggtacccgtcacagaccggaaaggatgtgctggcaggaagccggatatttctgcttccaagccagggtgtgaggcaaactcacccacaaagtactcagcgaggaaacaacagggcttctgacggcagccgctgtcgccgcagcctgcctttcccttgcacagtattttctgctggtaaagagcctcagcccaccgcgtctgcagacattgctgcgacgtcccagtgacagactgatattccctacacatttcaaatccaacacatcacacgtattagggatctccaggcatcccattcattccacttcacaggtgaggaaactgaggcacaggtaggttcagtgacacacccagagtcacctgcctcgaatgcagaagaggtgggactcagaccctggagcgcctggcttgagaagcacggctccacgcctgctcatgccccacccatcacaactacagagcgactctgcacactgctgttatactcgtatatgctcttataaagagaatttactttattcttatttagttggcaattttcattttaaagcataaaaccaggagaatgcaaacttttagcatttacatgcctttagttctgtaagtttggtcaaatggatgtgatatttacagatcaatagtaaaatctgctgaggtgaggagaagcccctggtacttaacctttcctttacagaacacgttggagaaaattgccaacatgaggccccgatgaacaagggcagaagttcaaggctaccttagaactgcttaattagatacctttcagaaagggcagcctggctgtgacagctgtgtggatatacaccgggagggagagactcccatggcatgcaattaggaccaaagaatttttaacgtcttggtaatgatgctctctggccctgtatcttgattaactggatgttgactgccacagggtgaatgacaaagaagagcacattaaaaaaacccactataagaaccagctgccttttcttgcataagatgcataaatcattgcgtgggaagcagcgtaggtctcaaaggggcaaattgagagacagagagacagaaagagaccgaggcagaaagacacacacagagacagagagagacagacacacactcatacacacacacacgcgtgcgcatagatattcctacccttaccatggaagaacaatattttttcatcaatttctctttgttgtactcagtagcattctgatcagtaggctgtgttccattcacattgaaacaggaagagcgttcattatttatgagatgtgtatttataaatgtgtattaataacccacatattataacatgtgttagtgaaccatgctccgggcctcctcgctgcccctgggagtgacaggtcttcttgtgtatgaccctgggcaaagggtcaaatgatggccagtgactggcctctggagtatgagctcagggttcattagcaaatcaaaaatgcacaggttagcaattttccaactggaaaagaactgatcttctaacacctctaaacttcccggattaaaagagaattctgaagcccgaggaaggcaccttgctttggaggtgctgggtccaggggatgtccagggctgcaggaatttcactacatgactcaagggcacatgccaggggccatcctagagaacacgacagtggcagaaccctgtcaatatggagctccaacaacacctaaaataaatacatcagcggcgccacgtgtgcagatgcttggtcttccagagggcaacacaaggtggcctccaggtgccatggactgtcaggggccgctgtcctcacagcatctggctgaagccagaagcgtccactcctacactggtttcaaaccgcgcagaggaggaggggatcaggccactcaccatctgcaggacatcggaggagaccatctgcatacagcacatggctgtggccagcgcacacacgatagtggacaggacgttgagggcacacacgctgaagaggagatcctgcgaggaaaggtgcaggagaatgtcagcctcatcccgaaatagatagcagaatccttagccctcctgccagggcccagaatgagccgaggtcgatgaccatccacttcatggaggttttgttttgtgtgtgtctgtgttttcctcataatcaaaattggcctttcatagaaacacattcgtttattccgttacaatgatgagcaaagtattcataatactcaacaatgtgttttacaattttgataattattaggtagtcagtaacatgtctaaggaaatcataaggtggccaacatttaaggaggtgggccatttttatcaaacacaacctataactcaagtgaaactttttatcttgagataattgtatattcacatgcaattgtaagaaatcctacagagagatcttgggtaccctttactcattctcccttaatggtaacatttggcaaatctatagtacaatatcacagccagatactgacattggtatagtcaggatgcagaatagtcccatcaccacacgggtccccccagtgttgaccttttatagacacactcacctccctttccctgctccccatttaacccccagttctgatcccctgtcaatcgctagtctgttctccattttttataattttgtcatttcaagaatgttgcataagtggattgcacagcatgtaacctttcagaattggctttttccactcagcataattccctttagactcatccaggttgttgcatgtatcagtagttgacttctttttattgctgagtggtattccaccatatggatgtaccacattggtttaatcctcaacaactgaagaatatctggttttttggtattccagttttccagttgtgggctattacaaataaagctgttgtgagcctttgtttataggtttttgtgtgaacataagtttttgtttctccgagataaatgtccaggagcacaattgctgatttgtacagtaattgcatgtttagttttattttaaaaactgaaaaaatgccttccagagtggctgaacaatttttaattcccaccagcagtgtatgagtgattgggtttctctgcatgattgccaacatttggtgtcactgtttgtgttttagctattctcataggtgcataatgatactcctttataaaatgttttattttgcatttccctgatgctaatgatgtcgaacatcttttcatgtgcttatttgccatctagagatcctctttggtaaaatgtctgttcatgttttttgcccattttctaattgattgtaatgtttacttttttttttttgtagtgttgagttatgagagttctttatgtattctaggtactagttctttgtcagataggtggtttgcaaatattttcccccagactgtagcttgtcttttcatgtttcacatagagtcttagtcagctcaggctgctattacaaaaataccatagaccaggtagctctaacaacagtcacttctcacagtcctgaagtctggaagtctgagatcagggtgccagcctgttggattctggtaagggcctgcttcctggttgaagatggctaatgtctcactgtgtccttgcttagtgaaaagagggcaggggagctctctggtgcctcttttaaaagtgtattaatcccatcatgtggaatctaccctcatgacctaacaacctcccaaaggccctgcctcctattaaataataacatattgggaattagaatttcaacatatgaattttggagggacacaagcattaagtccattatatctgagtttttaaagaacaaaaaattttaatgttcttgagatccaactgatcaacttttgttccatacttttggtgtcaagtctaaaactttgtcaagccccagattgtgaacagtttctcccatttttttctgaaagtttttatagtttcatagtttgcatttaagtctatgctccatttttgttctgagacagggtcttgctctgttgcccaggctggagtgcagtggcacagtcatggctcactgcagcctcgaccttctgggctcaagtgatcctcccacctcagcctcctcagtaactgagaccacacatgcataccactgtgcccagctaatatcatccattttaagttaaattttgaataagatgtgagttttaggtttaggttcctttttatgtttttaatttcattttccaaatgttgttagtacatagaaatgtgattgatttttgtatgtctatgtgatatcttgagactttgctgaaattgatatcttgggactttgctgaaattattagttctaacaattttttgaagatgccaggggattttctgtgtagacaatcaggccatctgcaagtgttttattgatttccttccattttattaccttttattattattattgttctttttttttgcctcgtggtgctagctagaaccttgagcattataaataaaaatataagatgactaagatcatgaaagcagacatctccatcttgtgctcttagagggtaaacttgatggagttttaacagtcgaagtgcaatatagccttcattgagaagcttactctcaaatccatgtcagaaatagaaaaaaaaaagatttagaatgatagtatgtccttcaattaaatcttttcatatacaagtgtacaaaatactggacacactcaaaaagctatcagaaaacatgaatctttcaccacaaaggctatggcattaatcagattagtttcagttatctaatcaaggggttggcaagtgctcaagaggagacggggaatgccaccctcactgacatgctctgtgcgtgtgctaggatgtgggcacacagagtctagcagcatcctcagggctcgttcatgtatacatgagcccatgtgttccaatctgtaacatcctctggacaattccctgttctcctacaaacatcactgcccaatccccttcctcagaagctgctcatcagttctcaagcccacactgtgaaacagtaaagaagtgtgattaggataatatcatggaaggtggttaacatacagtgtttaaacactttcccaagtttatagaaccccatgcacatgtgaaggcagaaaaatgagtcctgaacttaagaagcgttaggcagaaccggccgggcgtggtggctcatgcctgtaatcccagcactttgggaggccaaggtgggtggatcacaaggtcaggagatcgagaccatcctggctaacacggtgaaaccccgtctctactaaaaatacaaaaaattagtcgggcgtggtggccggcgcctgtagtcccagctacttgggaggctgaggcaggagaatggcgtgaacccaggaggtggagcttgcagtgagccaagatcgcgccactgcactccagcctgggcaacagaacgagactccatctcataaaaagaaaaaaaaaaaaaagaagaagcgttaggcagaaccaaggcaaggctcagtttagggctaactattccccactttggaggtaaggcctatccgagtccctgaatgatgtgggaacaggcactgttcctgtgtgagcaccaggcactgttatcactaatcctttcaggcagttcttttcccagactcaggtcgtttcttcatatgcacgtgctaaccagcatccaactgacaactccaggcagaccctctgaagacccccatgtttctctcctggtgcagctctgccctcgatggtgctctgtcctaagaactcttgtctccaggccttgatccccctcagactctcagccctctacgcccaccccagggagtctgcagggaccctgctgtgttccctttccagcactgaacctggaaactgtctcaaggcagtaagctggggcaatcgtagggctcacctcatttatcacccacccctcagggatcagggttcttcattgcctgatagtgtcttcctacactgtgttcattttggggggctgtttcaggcaggaggttaaatccaatgtcctgctactccatcttggccagaagctcttggtggcttttttgtttgcgttttctaatgtttgtagcaggactaggcggactgccttagggatcctactataggcatctccactgccctccctgctcctacagctgctagacatggagcaggatgggggcttagttgtggcaaacagcaggcacaggtggggctggagggaggctgaggagcctagattgtattttgcaggtaatggaatgccactgaagatgtgtgatgctgggaaagaggtcatacaacctgttttttgttgttgttgttgtttgtggtggtggtggcgtttttgttttgttttgttttgtttttgagatggagtcttgctccagtccatgctggagtgcagtagcgtgatcttggctcactgcaacttccatctcccaggttcaagcgattctcctgcctcagcctcctgagtagctgggtctacaggtgcccgccaccatggctggctaattttttttgtatttttagtagagatggggtttcaccatgttggccaggctggtctcgaactcctgacctcaggtgatccaccctcctcggcctcccaaagtgctgggattacaagtgcaagccacggtgcctagcccatgcaacctgttttgagaattgattgagaaagacacctttgcagggagggcctagcacagaactatagatggagtaaacatcggttgaagtgagactggacacagggcagtgacccgtgaggcggtaccggagaggagtcaagcagagcccaggaggaggcatgcagatgccggtctgagggtgactctgaagttcagaacaaaagggcgtggctgtttactggagtaggggagaccgggatgagggtgcagatatagtagaaagatgattctggtgagtggaaacatgagatgcctgcgcgtgggccagggactgtgggagagaagcagtcttaacgaacacctcagcaggccaggcgcagtggctcatgcgaggcgggaggatcacttgaggtcaggagttcgagaccagtctgaccaacatggtgaaaccccgtctccactaaaaatataaaaaaattagccgggagaggtggcacatgcctgtaatcccagctactcaggaggctgaggcaggagaatcggttgaacctgggaggtggaggtagccgtgagccgagatcatgccattgtattccagcctgggcgacaaagcgagactctgtctggaagaaaaaaaataaaaaataaaacacctgaagtggtctgggacatgtggaggctgagttaccagtgggcctgacccactgagatgttggcaaatggttggaaatttggggctggggctgacgatggagatcagaactggaggtgtggaccaggagtcatccctacagagttcaaatgtgccttcaccttgcggatgtccttgatgtatctgcgggcccctgtgtgtcctcattcccctctccagatccatcagacttcaggggcctgggggcctccgcaggctccctacagaagagggcatttctttgatgaaattaccattctcacctcaaagatacacctcagcatagttttcctctaagtgacatgaattttgtgctggattctagaaaactgacagatttatccatgtgcgcagtagctggctgagtgccttttctctcctgtgaggaagagcttctaaaatgtcttaaggctcagccagaagctttagcacatttttgagcaggaagttggactcactgtagtcttaaaacaatcctgctggtgaatgaagtcataattagaactcttaagtatgtattttatatatctcaggagaacaattcaaagttataactaaaatagcgacatcttttttttttttttttgagatggagtctcgctgtgtcgcccaggctggaatgcagtggcgcgatatcggctcactgcaacttccacctcccaacttcaagtgattctcctgcctcagcctcccgagtagctgggattacaggcatacgccaccacgcccagctgatttttgttatttttagtagagacggggtttcaccatgttggccaggatgacctgaggtgatccagccgccttggcctcccaaagtgctgggattatagacgtgagccactgctcccggccaatagcgacatctcttaatgtaccattgctaaaatataagcaatacctttactttgtcctcaatctagaaatttcaactttattgaccacataatccactgtcatttaaatgaatgcctttctacaaataatattaatttcgcatatgctaccaaatgaaactactcacagacagaaacaccaactctgacctctgtttgcatacgcatcatgaggcagcctgctttacgtctcatgaaaggtattcatttgaaatacatgccagaaagacttttcccctccagctgtttaaatacttgatgtttttctaagtaaccgcaaaccacctggtattgcgtttatgtgtttcttcagaattcttttttggcttaaatgacattatctctgccttttttttttttttttttgagatgtagtctcactctttcgcccaggctggagtgcagtggcgtgatctcggctcactgcaacctccacctcccgggttcaagggattctcctgcctcagcctcccaagtatctggactacaggagcacgccatcactcccgtctaattttgatgtatatttttttaagtagagatagggtttcaccatgttggctaggctatctctgctttttgaaagttttatcagagtcctttacaaatactgaaatccacattctataaaattcctttacaaggtgattcaaaacggcgaatatgagagagaggcgggtctttcattgctgatactgagttttgctactggatattctgatgttattagctttttgatgttattaatgttataaagttaaggaagttatgtatctaataaatgatgtatagaacaaaaacaagagaaaaaagttttagatacttgggcaaagctacagttgataaattattttgaaaatctctccagtctacgtaagttatggatattaataataagattaacagagaaaagcgacagcaatgacaatgtacatacatatagcctacacgttaaaaacattaaacagttcaggacattgagcgggtcgtggtagtgtatctggaattggtgggttattggtctcactgacttcaagaacgaagctgtggaccctcgcgctgagtgttacagctcttaaaggtggcgtgtctggagtctgttcgttctgatgtgtttggagttttttctggtgggtttgtggtctcgctggcctaggagtgaaaccacagacctccgcggtgagtgttacagctcttaaggcggcgtgtctgaagttgctcattcctcccgataggttcgtggtctcgctggctccaggagtgaagctgcagaccttcacggtgttacagctcataaaggcaaggtggaccgagagagtgagcagcagcaagatttattgcaaacagcataataacaaagcttccacagcatagaaaaggacagggccgggttgctactgctagcttgggcagcctgcttttattcttatctggccccacccacatcctgctgattggtccattttacagagagccgattggtccattttacagagagctgattggtccgttttgacagggtgctgattggtgcgtttataattcctgagctagacacaaaagttctccatgtcacaactagattagctagatacagtgtccacacaaaggctctccaagtccccaccagagtagctagatacagagtgtcgattggtgcattcacaaaccctgagttagacacagggtgctgattggtgtgtttacaaaccttgagctagacacagagtgccgactggtgtatttataatcccttagctagacataaaggttctccaagtccccaccagactcaggagcccagctggcttcacccggtggatcccgcaggtggagctgcctgccagtaccgcgctgtgcgcctgcactcctcagcccttgggtggtgtatgggattgggtgccatggagcaggaggcggcgctcgcccgggaggctcgggccgcacaggagcccacggagacgggggaggctcaggcatggtaggctgcaggtcctgagccttgcccagagggaaggcagctaaggcccggtgagaaattgagcacagcagctgctggcccaggtgctaagcccctcactgctccagcaggcagggccagctggccactcccagtgcggggccgcggagcccacgcccacttggaactcctgctggcctgcaagtaccacgcgcagccccggttcccgcccacgcgtctccctccacacctccctgcaaggtgagggaaccgactctggccttggcaaacccagaaaggggctcccacagtgcagcgtgggctgaagggctcctcaagtgccgccaaagtgggagcccaggcagaggaggcaccgagagccagggaaggctgcgaggactgccagcacgctgtcacctctcagtagctcacacctgtaatctcagcacttttggaggctaaggtcagatcatctgaggtcaggagtttgaaaccagcctggccaacatgatgaaaccctgcctctactaaaaatacaaaaattagccaggcgtggtggcaggcacctgtaatcccagctactcaggaggctgaggcaggagaatcactcaaacctgggaggcagaggttgcagtgagccaagatcacaccaccgcactccagcctgggtgacagagtgagactctgtctcaaaaaaaaaaaaaaaaaaaaaaaaaatcaggacgttgatacctttgcttgctggacaaaatgaggacaaactatcttacatttatttccgctagttcattcagtagtttttttcctatgtcttctctctttgaataggagagaggtctcatgggaacctattatcagtcaagatataatgatagaaggtatgatgataaggagagttccacagcataaaacacaagcggaagaaatatccagcaatagctgtatatgtggtaataattataagggatgggtgttgggctttatctgaattattatcttaaatgcccacaccatttattctttgttgccttgtgatggtagacattggtcatggacctgacgttccgtgcagatctatgttgggagaggcagtctgccatgggccctgagcatgccctgaagttcctgctgggtatgccaagaatgtaaggccttgactgctctttacctgacccatttcccagggctgtgtttgcaccaagaaaccttgaggaaggaggtaacgtctcccctagacaaagtgtaggttctctacaaagacagggattccccaagctcagtgtttctgccccataacgcagctcaccacacatgtgcaggcatccgtggtgggcccttagcatcaccctgagaccccagggcatggggaactgacacacactagcctagagctctggctactgcttttgccatgaataataaagtcccttgtctctgaaccaggaatctcatgtctttttgccaggaaagtaacagtaaacagtaacagactagtttgttagcttgaaagtaggttaaaagctcagaccctgcagttcctggcagtttatttccatctccatcttgtaagaacatcaagagcagagaccaagtcttttgctactctgtatggtagaatatcttattcaaaataggtggttgctaaatatttgaaattttacaggctcattgttctcttctgaattgtaagttcagactagaaggaaatgcataatttccaagcttctaaccacacacagaaaattcaccttcacctttaagtaaagtaatgcagcacacataggatcatggtggacgggaggcaggactagattgcagctctgaacagagcaatgtgcagaggcttgcattgtgaattttagctccagatcgactgcaagaacaaaccagcaaccccgagaggaccgacagacctctgaaggaagcagactgctcttgcaggacctggaagacaccccaaatactgtgagtgcccaaactgcggaagtgggaaagggagagcatcctctcccaaacacacacgcccactggagaaaaggaaggtctgtttgcaggagaagtttccgaccttacctggagctgagtcaatttagagagtcgagcgaaatacagaagtagaggaagcagcgggaaaggccctgggagctccctgggtccccaagcaggtcattcctgcctggcaccacagggatccaccaggagggcagccagaggagcgagggtaaaactcaacagggagaaggaaatctctagctgaaatttgtaacaatttgaacagggttagaagcctcctggccagaactcgggggagggcgcaaatctggtgtgcagattctccacaggtgggaagaacaagccctttcttttgcagctgggaggtgggtagcctgaggcaagttctcaagcctgtctcacccactgcccgaaaacagacttggggcggttggatgggggcatggtgggagtgagactggactttcagtttgcatgggagctgggtgaggcctgtgactgccagctttccaccacttctctgaaaacctgcatgactcagcagaggcagccataatcctcctaggtacataactccagtgacctgggaatctcacacccatcccccacaggagctgcagcaagaccggtccaaagagagtctgagctcagatacgcctggccccacccccacctgatcgtccttccctacccactctggtagcagaaaacaaaggacatataatcttgggagttctacagcccagcccacagccagtccctctcaaactactacagctgatgctttctggaaagcgccacctcacagcaggaggccaacccgcacaaaaatagagcattaaaccaccaaagctaagagccctcacgaagtccactgcacaccccccaccacctccactggaacaggtgctggtatccatggctgagagacccatagacggttcacatcacaggactctgtgcagacaaccctcagaaccagcccggagctgggcagacttactgcgtggccagacccagaagagagacaacaatcactgcagttgggctcacaggaagccacctccataggaaaagggggagattactccatgaagggagcactccatgggacaaaagaatctgaacaacagccttcagccctagaccttccctctgacagagcttaccctaatgagaaggaaccacaaaaccaatgctggtaatatgacaaaataaggctcttgaacagcaccccccaaaatcacactagtttaccagcaatggatccaacccaagaagaaatccctgatttacctgaaaaagaattcaggaggttagttattaagctaatcagggaggcaccagagaaaggtgaagctcaatgcaaggaaatccaaaaaacgatacaagaagtgacgggagaaatagccaagaaaatagatagcttaaagaaaaaaaaataaataaaaaatccaggaaaaattggacacacttatagtaatgcaaaatgctctggaaagtctcaggaatagaattgaaaaagtagaagaaattcagagctcaaagacaaggtctttgaattaacccaatcccacaaagacaaagaaaaaagaataagaaaatatgaacaaagcctccaagaagtctgggattatgttaaatgaccaaacctaagaataaccagttttcccgaggaagaagagaattataaaagcttggaaaacatatctttaggaataatagaggaaaacttccctggccttgctagagacctagctatccaagtgcaagaagaacaaagaacacctgggaaattcattgcaaaaagatcattgcctaggcatattgtcatcaggttatccaaagttaagacaaagtaaagaattttaagagctgtgagacagaagcaccaggtaacctataaaagaaaacctatcagattaacagcagatttctcagcagaaaccctacaagctagaagggattggggctctatcttcagcctcctcaaacaaaacgattatcagctaagaattttgtattcagcaaaactaagcatcatatatgaaagaagatacagtctttttcagacaaacaaatgctgagagaattcgtcactaacaagccaccattaaaagaactgctaaaaggagctctaaatcttgaaacaaatcctggaaacacatcaaaacagaacctctttaaagcataaatcacacaggacctataaaacaaaaatacaagttaaaaggcaaaaacaaaaaacaaaaaaccaaagtccacaggcaacaaatagcacaatgaatgcaatggtacctcacatctcaattccaacattgaatgtaaatggcctaaatgctctactttaaggatacagaactgcagaatggataagaactcgccaaccaactatctgctgccttcaggagactcacctaacacataaggactcacataaagtaaagaggtggaaaaaggcatttcacacaaatggacaagagagtaggggtagctattcttatatcagacaaaacaaactttaaagcaatatcagttaaaagagacaaagtgggacattatataatagtaaaaggccttgtccaacaggaaaatatcataatcctaaaaatatatgcatctaacactggagcgccaaaatttatacaacaattactaatagacctaagaaatgagatagacagcaacacaataatagtgggggacttcaatactccactgacagcactaggcaagtcatcaagacagaaagtcaacaaagaaacaatggatttaaactataccttggaacaaatggacttaaaagatatatacagaacatttcatccaacaacctcagaatacacattctattcaacagcacgtggaaatttctccaagatagactatatgataggccataaaacaagactcaataaatttaagaaaattgaaattatatcaagcactctctcagtggaatcaaactggaaatcaactccaaaaggaaccttcaaaaccatgctgatacatggaaattaaataacctactcctgaatgagcattgggtcaaaaacgaaatcaaggtggaaattaaaaaattcttcgaactgaacgacaataatgacacaacctaccaaaacctctgggatataagcagaggtggtgccaagaggaaagttcatagccctaaacgcctacatcaaaaagactgaaagggcacacactgacattctaaggtcacacctcaaggaactagagaaacaagaaaaaccaaacccaaacccagcagaagaaaggaaataaccaagatcagagcagaactaaatgaaattgaaacaaacaaacaaacaaaaatacaaaagataaatgaaacaaaaagatggttctttgaaaaggtaagtaaaactgatagaccattagtaagattaaccaagaaaagaagagagaaaatccaaataacctcattaagaaatgaaacaggagatattacagttgacaccactgaaatacaaaagatcattcaaggctactatgaacacctttacacacatcaactagaaaacctagaagagttggataaattctggaaagatataaccctcctagcttaaatcaggaagaattagataccttgaacagaccagtaacaagctgcaagactgaaatggtaattacaaaattaccaacaacaaaaaatgtccacgaccagacagattctaagaagactttctaagaagaattggtaccaatccttttgacactattccacaagataagagaaagaaggaactctctctaattcattctatgaagccagcatcaccctaataccaaaaccaggaaaggacctaaccaaaaaagaaaactacagaccgatatccttgatgaacatagatgccaaaatccttaacaaaatattagctaactgaatccaacaacatatcaaaaagacaatacatcatgatcaagtgagtttcataccagggatgcagggatggtttaacatatgcaagtcaataaatgtgacacatcacataaacagaattaaaaacaaaaatcacatgatcatctcaacagatgcagaaaaagcatttgataaaatccagcattgctttatggttacaattctcagcaaaattagcatacaagggacatacctcaatgtaataaaagccatctatgacaaaaccacaggcaacataatactgaatggggaaaaactgaaagcgttccctctgagaactgaaacaagacaaggatgcccactctgaccactcctcttcaacatactactgaagtcctagccagagtaatcagacaagagaaagaaatacagggcatccaagttggtaaaaaggaagtcaaactgtcactgtttgctgacgatatgatcatttaccttgaaaaccctgaagactcctccagaaagcttctataactgataaaagaattcagcaaaatttccagatacaagatgaatgtacagaagtcagtagctcttctatacaccaacagtgaccaagccaagaatcaaatcaagaactcaaccccttttacaatagctgcaaaaaaataaaatacttagaaatatacctaaccaaggagtcaaaagacatctacaagaaaaactacaaaacactgctgaaagtaatcataaacaacacaaataaattgaaacacatcccaggctcgtgaatgggtagaatcaatactgtgaaaatgaccataccagcaaaagcaatctacaaattcattgcaatccccatcaaaataccaccatcattcttcacagaattagaaaaaacaattctaaaattcatatggaaccaaaaaagagcccacatagccaaagcaagacgaagcaaaaagaaaaaatctggaggcatcgcactacctgatttcaaactatactataaggccaaagttgcaaaacagcatggtactagtataaaaataagcacatggaccaatggaacagaatacagaacccagaaataaaccaagtacttaaagccaaccgatctttgacaaagcaaacattaacataaagtggggaaaggacactcttttcaacaaatggtgttgggataatcggctagccacatgtaggagaatgaaactggatcctcatctgtcaccttatacaaaaatcaactcaagatggattaaagacttaaatctaagacctgaaactataaaaattctagaagataacatcggaaaaacccttctaggcattggcttaggcaaggatttcatgaccgagaacccaaaagcaaatacaataaaaacaaagatcaatagctgggatcaaattaaactaaagaggttttgcatggcaaaagaaacagtcagtagagtaaacagacaatccacagagtgggagaaaatcttcacaatctatacatctgacaaaggactaatatccagaatctacaacaaactgaaacaaatcaataagaaaaaaacaaagaatcccatcaaagagtgggctgacatgaacagacaattctcaaaagaagatatacaaatggccaacaaacatatgaaaaaatgctcaacatcactaatgatcagggaaatgcaaatcaaaaccacagtgtgataccacgttactcctgcaagaatggccataatcaaaaaatcaacaaacagtagatgttgacatggatgtggtgaacagggagcacttctacactgctggtgggaatgtaaactcgtgcagccactatggaaaacagtgtggagactccttaaagaactaaaagtagagctaccatttgatccagtaatcccactactgggtatctacccagaggaaaagaattcattatatgaggaagatacttgcacacgcatgtttatagcaacacaattcaattcacacttgcaaaattgtggaaccaacccaaatgcccatcaatcaatgagtggataaaggaacggtggtatatatatatgatggaatactacttagccataaaaaggaatgaagtaacagcatttgcagtgacctggataagattggagactcttattctaagtgaagtaactcaggaatggaaaaccaaacatcgtacgttctcattgatatgtgggagctaagctatgaggatgcaagggcataagaatgatacaaaagcataagaatgatacaatggggagaatagtgggaggcgggaaagggataaaagactacaaatagggtgcagtgtatactgctcgggtgttgagtgcaccaaaatctcacaaatcaccactaaagaacttactcatgtaaccaaataccacctgtaccccaataacttatggaaaaaaagaatttaaaaaaacctactacacatagttacaaacccaataaagaaagaaagtaatgcagagaaagactctgtacaaagactcttgttggtagcacaatcagcgtgtgtgtgtaaaatctgtaatttaaattttccacgaaatttctagagtgatgagacacatcctggggcagatctaggactgtttaatttgtctctgtagaaagcagttatagtctacagaggtctttgtggcgggcttaaatactgatcctacaaaaggagctaaaattaggctgtcatatggagaaggtaagtgattcatagagaaatctgtgaagctataatttcaagaggcaaacatccatttacaatccctaaaaatgtcgatggattttggccttgctttggccactcaggcaccaccagtaacacatgtgctgctctaagaaggcaggattgctccccacatggtgcctgctgtttgctcaatggcacttttaactctgggcaaggacccaggagggagttcacacactctccgcaagggttcagaactgcaccctatttgataattgaaaacctggcttttgtcatctgaaacaatagcttttactctttagtggatggctgtaaattgcctacatgatcatctgtgtaaataatcgtagactaattattttcttacagttctacgaagttttaagaagaaaactatttgccatttttctgatattcaaggcaaagtaatgaggcaaaaaaagtttctgtgtgtatacacacttttgtatctttgtgtgtgtatatatgagatagattatacacatacatgcatatatacatacagaaatctttcctataaattctggatttctgaagactcactgtgatcctaatgagcctctagctttaaaacaatgttgaacaaaacaccatttttaaatatttggctttaacctaaatttatgggaatgaagaaaataaacaagcattgtcaagaacattttgggaaaaaaaaggctttgcacacatcaaaatgtaccctaaatctacaataatagtatagggtggcatcaataagggacagaatagagatcctattataataaaagaagtacaccacattacttgtgttgggataattggctgtctttaaaaaacaagtaagacagatctagatgtgaaaagaagagaggaaaattcttcctcgtgaacctagatgcaaaagtcctaaataaaatattgaaaaattaaatacagtagcattttaaaaaacatattatgaccaaatgtggtttattcctatattacaaggatgttttaacataatgtaatttattaatggaattcactacattaaatgagaaaaactatatgacaatctcaatagatgcaaaatagcagttggtatttcaacactagtgtaaaagcctctaataaacttgaaatagacaggagctccctaaactcaagaaaccctacagcaaacatctggaaggagatggggattgctgccaatatcacttctgttctacacaggtcccagtcattggaagaagacaggcaaaagaagtaaagtgtgttcaaactgggaaggaagaaaaactgtccaagatgatacaattattcatacagaaaactcaataacatttccaaatatttagaactaaatataatagttgtgcaatgttgctgcatataaaatcaatatgcaggccgggtgcggtggctcatgcctgtaatcccagcactttggagggccgaggcagggggatcatgaggtcagaagattgagaccatcctggctaacatggtgaaacccccatctctactaaaaataaaaaaaattagccaggcgtggtggcgggtgcttgtagtcccagctactcaggaggctgaggcagaagaatggcgtgaacccgggaggtggagcttgcagtgagctgagatcgtgccactgcactccagcctgggtgacagagcgagactccatctcaaaaaaaaaaaaaaaaaaaaaaaaatcaatatgcaaaattcattcactagcaacaaacagcaagtataagttttttaaagatacgatttacaatagcaaaaaatgtaaagtagccaagaataaatatagaaaaaggtggaaaaatgtgttgagaacaaataaataatgagatcttgtagtcatgaataggaagattcaatactataaatacattaattctttccaaatcaacttataaatccaatggaattccaacaaagaccacaacaagactgtgtgtgtgtgtgtgtgagtgtgtgtgtgtgcatagtctgtgacaggatcattttaaattcctcatctcccttctctctcccacccctgctgccccacaccatgtgaggacacagtgacaaggcttgcctttgtaaaacaggaagagggcgcttgccagaactcgaccatgctggcactttgatctcagacttctagcctcctgactgtgagaaataaatgtctgctgtttataccaccccatctaaagcattctgttacagcaacctgtcttagtctattttctgctgctgtaacggaataacagactgggtaatttacaaagaatgtaagtctatttggcccacagttctggaggctgggaagtcctagagcatggggccagcatctggtgggggtcctcctgtggtggaaggtgaaaggcagaaagctgaagtgagtgtgtgagacagagagagaagccagatttcctttataacaacccactctcaccataactaacctctcccatgctaatgacaatccatacatgagtgctccactctcacgacccaatcacctattattaaattcgacctccaacactgactgtggcattgaggattatgtttccaacatatgaacttttgggggactattcaaaccacagcacagcctgaactgattaagacagtgggcttttctatcttctatcattaaaccatccgaaacaccattagtcctctgactgcaggtccagctgtcctgagcagttcaacatttcatatttcgaggaatgcaggttcactcataaacaacacctgtgacagagccaccctcactcacatcctggacactctactgtctgttcacccctgtgcattccaggatgtaacaggcaagatgatcccaactcaggcacagctgcagtgtctacagctgcaggaggtcctgtctccctcctgcccccagcaagaaaacccaagtaaggtatttttttttaaggtatagtttttttccttcaagtttctaattttgacacaatgaaaatattgtatttatattagcaatacccgattagcaatttcatgtaaaggcgattaggtactcataaaaggtctcaagtactccaactaaatcagtcactggttaataacaatgatccacgagctgttttcctggttttcatgtggaataattggcaaggaaaaccatacatgaaaaaagaaaaaagaaaaagatcagcaactttgcagctttagccactatgtgatgtgctatcaaaaagccacctagaatcttttttcatgagttaaaacactactgtcatctataatcctgaacggtaaggtctagaaaccaatactgacagaggtgtccaaacagctcctcttgcagtgctgtggggcacatttcttttaaccttaattgacttcaattactgtgcttcatctcccatggcaaaataattccccaaagaaacaaagagtattagagtgttttcactcatgaaacagcccgtaatgcacctcttttgcttaggaattggaagccaactagatttgagcctgcttgaaagaaaatctcatcactgaagaatccattagtgggccctccaaaatccacacagtcttaaggccagggaccaactggacttcaggaataggatcaaaaaagccaattccagttccatcgtgatgtactgatttaactttgattgtgaaggacagtaatttattgagtaatttatcttgctaaccaccatattaatccagtatccaatcagcacttctctcattcaattccaaggagcaggagtcctagatggttggaagtgtcagacaggaagggaagagtgtcttctagtgtcttgcccagtaattgtacggggctccaaactcctggggagggggaatgatgtctgacttggagcaggccagtggggatggacagagaaaaatttcagcaggtgcccattgctggagtgcaataagtagagcccggggtgatgagaggcctgggggagaagggagagggagggatgacagagaggacaataggaacacagggtcccttgcccttcataatgcccttgattcttgttaaagggaaatgccacggatgtggttggtggagccaacatctctgcctcatccttgatcatcccacacaccccacatccaaattctccctggcgtgttgacccggctaccaacctcacctgcaatcctccctgggctccagctccacctgccctggctgaacctccccctctcacctggactctgaggtggcctcccagtacctcaggtctactcttccctgtcaggacacctgttttagcctaagtcggctcctgtccctcccaggttacagtctgtggcgggaggcccaccagtgataaaatctccgcgccttcccccgtccctggctggcaccctctgcagcctatttctgcctcatttccacggaggctgtctcccattttctctgcagaccagcccccaagtacacatcgtgctaccatagttccacactggtctagctctctccgcttcccagtcccccgcccagggaaggggctcactgaaccagcctgggcacgtgtccactcccaggacagtccactgcaggaatgggcggggcagggtgcacaggagggtgctgtaagctgggcctgctttctaagccaacctgggtgattggggagccaactcaccatggggccgctgcctagcccctctgcttctacgtgactatgatagaagacggcactgaagccttccctctgagaaagttctcagatcttcttttggtcacttctggctcacaccccacaaaagatcccctggacggaagcctcagctctcttatttctggggatgtggctttgagggtttcctcatcgctctgagccttgatctcatctgtgaggggatgactggcttagactttaaactcaagtaggtgaaccccggggcacttggtaaagggaagccctcctgggaggattccgccagggtgtgcagagccacccgtgatagcaagtgatctcattactggaaggttctgaatcggggggagatggtcaccagcacctcggagggttggggcaccattcatcttctgattggttatcatatttggtttgatttcagtcaccccagaggaccaaaatgactaaaataagtaagttattcatctataaacattatgaagcattttcaggcatttaacagatgtaataattacctatatctaagtcatatttgaagggtaactaaattttaattgctttataatatgtcttataatctttttattagcaattatataagcaattgattgtaactatctgtaagtgaaaactaatatctggatagccaaaaaaaaaaaaaaagccaaaaaatcccactctttcatttagatgactggggaatattgaagagtcggggaaatagcaggctctattttaagcatcattttaaaggaaatataacacaatcttaatcgtaggtggaaaaaactccaaagagtacttgttatgattgcaaattcctaagtaaaagccatctacagatgtgacttgtttccaggtattactcttgattttggggacatgtctcttcccttgatgggagaccccctgggtcactgcatcccttgtacatcaaggtttctttcatggcagatgtcatgtcatttttttctccatgtatcagaacgacaactcattccttgcatgacaatggagtggaaatgcagggagacctcaatgacattttattcagctgacaaggaagagacaaactgccttgtcccaggagtctgtgaaaactagaaacacggccaggcacggtggctcacgcctgtaatcccagcactttgggaggccgaggcgggcagatcatgagatcaggagattgagaccatcctggctaacacggtgaaacctcgtctctactaaaaatacaaaaaaattagccgggcatggtggcgggcgcctgtattcccagctacttgggaggctgaggcaggagaatggcctgaacctgggaggcggggtcttgcagtgagctgagatcgcgccactgcgctctagcctgggcgacagagtgagactccaactaaacaaaacaaaacaaaacaacaaaaaaaaaaaagaaaactagaaacacctcatactgggaactataaagctttgccactgccactgctttgtaaaacaagaacttttccctgcctaaggtatctatttcataggtagaattcataacacactaaaacctttgacttggcctgcttggtatagaaaacttatgcatcacaaaatattctgctcagagtataagcacataggtaatgcatgaatttgtggtttatcaattttcaaagaaccttttacaaagacactgaatatatatgagagtaaacatgttgtgatttttggtagttcagacagtaatcagtttctcgctgggcctcagcttgttctgagcattcaggtccacagtcctgaagctaagctagtgtcccgggtagcagcctggtgtatgtatcactgcatatggcggtgagagccagggctccaaagccagactgccggcctgggattctggctccacctttacaatctgcatgaccttggggagttactaaatttcactgtgcctcagtatcctcacctgtaaaatgagaataaatgatacgtgtacctcaccgggttcttgtaagggtaagattagtttcacaaatgtgctgccggtaacgcttagcacacagcaaggctcaatcaacattagctatgactatcatacacgattaatcatctgagtgtctgatcggattgaaaacacaggctcctgcagacaaattcagcagaggactttcaggcctcatgcatgaatgcttaaggaaaagagccctaaagattatgagacgcccatccaagaacatccaagaatgcgttttgcagtctgaactgattctccagggtgctccttgtgttcaactgatgggacaggaacgctgatgtttgtccatctctctttttcttcctttttgagacggagtctcactctgtcacccaggctggagtgcagtggcacgatctcggctcacagcaacctccacctcccaggttcaagtgattctcctgcctcagcctgctgagtagctgagattacaggtgcccgccaccatgcccggctaatttcttttgtatttttagtagagacggggtttcaccatgttggtcaggctggtctcgaacccctgacctcgtgatccacccgccttggcctcccaaagtgctgggataacaggcgtgagccactgtacccagactgtccatctttcattgctctactttctgggtcttgatcgtcctctctcatgactacttcttttactcccatcaaggtaaagtgtgagtgaaagtagtttgattaaagcccaggcagattaaggacgaagctaaaaagaatgaagagacactggtaggaaatactggctgacatgcagaagtaatttcaacgatcttattagcctttcgcctcttgagtacttggttaatgttcataaccagaagtaatgtctctaatctgcatttaactgatattctaactcttccttaaagatacagacctcttttcctcaggcttcataggctagacaattctccttaaatgtcctgagagccgtggcacataggggatgagtggtgggggggcacattcatttgcctggagtgtgggaggagcccccacctttcctgattaatgcagctggtagttctcagtgtgtgcagctgggtgggcctccagaacagtcagtttgggggccatgaggggcaggctctcctggatggtgacaataattttaagagaggggaggtcagtagttggaagtgggaagaggccagaggagagaagagggtggaagagcagagaagcatccctcctcagctcaccagacaaaggataaaatggaggaagtcacaggaccctttgccagagaagcccccaggaagtgtggcacatgcagggcaggagccacgggccccacttcatgctgaggtccttgccaagcccatggcccgcagaccctgttggacggggcagcaccgtgcacctgaaggctgaggccgggccccaggaggggttagatctctttccctccttccctccaggtcgccaggctttgctaatttcatcttccaaatatttaccaagttaatgcccttctcctcctactctgatgtgcctctgcagttttggtcccattatctctgcccaggttggtgtctgtgccctctctgggcctggctctcagtcctgtcccctgctgctgctggatgatctatttctgtaatgcatctggccactgccctctcttccctgctaccccaaacaccccaattcagtgtctccacgttgcctgcagctctgatactgcagggcccaggactttcaagaggtagagccaagggtgggagaaggaagagttggagggacgcccagctctccacctgggagctgagcagctaggggtggtggtgataacatcgacaaggttggaaagagaagcagaagctgagccaatggattccctctgggagcggctgggggaggatggcagggagtgatccgaggggtcccgctctcgtgtatgggactctgtcatgtgagtacacatgtgatggctggcaaaaaagcaactgtatggcaggatcctcatccacgggaaggacagggcttctattttaaaatacactgaacagcaagactgcacatgctttctggaatagaacataaatgcatctatgaatcaaagtcagaaaatatattggtggttgttttcttgctttattttgcgctctcacaggtgtgactatcagttttcaggaatatattctttgctcaatatgtatcttcttcctgccctccttgcttcctttccttcctccagtgcacacagatcgagcccacaacgcagcaagcacagagatgaaaagaggaagatagacgcggggtctgcacccacgaaactcagtctagagggacacaggggtgccctggccagcatctggactcgtgaggctgatgcatcaagccacggcagagctgcctgggaaaggtgcatagggagcactctcaggggccagaggaagggacatccaggcggcaccgggcagtgaggcaagtcaagggtggcggaggttggtggggacagtgttactgggagagggaaggctgagtgcagaggtggagggtagggatgggcaggggcagaaagcactgtgaagggagcttagtggaagagggtgggcgaggggaggcagggcgggagggatacagggagaagggtggatgtgctgcagggacacccgggtggtgacaaaattaaagtgcctaaaaatactcaaggagaaatgaactttgttaacacagtttctttaagaatgtaacgtgcctgtaatcccaacacttagggaggttgaggcaggaggatcacttgagtccaggagttggggaccagcctgggcaacatagtcatgcctgtttctacaaatataaaaataaaattagctgcatatggtggtacgtgtctatggtcccagctactccagagactgaggcaggaggatggctggagcctgggaggtcaaggctgccgtgagctgtgattgtaccaccgcactccagcctgggcaacagagcaagaacctgtcttaaaaaaaaaaaaaaaaagaaagaaagaaagaaaaggaaaaagaaccggttaccatctcaatgaattagagaagacagaactaaagaatatttatatcctgcccaagtgttcacaatgcatctctccgttttcacaatgcacctttcttaccttctctctgttttttgttttttgtctggactaattgctagtcagactgttctcctctctgcagtcccctgaattctgcttgtccctggggcctgggcgagcgctagaaaggagaatgggccagtaatcagctcgtcccacagtgagacacatatcctggtcatcttcctttgctcacccaacttccccttaagtttctgctaagatttgctgacctccctgccctataaaagaaaagcccttttctgattgattttgagatgtttacagttcttgagttccaaggattctcccctgttagttgcaagagtctttttgaataaatcttctccttatctaagacaagattagttttgcttgacaatgcaaatgaccagagggacacagagaactaagaacattttttaaaagggaaaggtcttgttgaaattaaatctatacttaatcagtatcagatcatcttgtatttgagacttcctatcttgtgtcttgagaagggcaagaagcagtctggtgatactgagctataaactagaaaggttttgctatcatctttgcagaactgaactatttatgtggcctacaggcaggttttctgcaggatgttgtatttgttatatgtttatgggaaccattcttctctcgaaataacaggctaaatttgccattaggacattgaatttacccacaaactttgtaataaatactcttcaggctaggatggtaatggctttactttggtctaaccagtctctaagtaaatagtatgaatattcttgctggtttggaactgctctccgctcaatttcattttcctcctggacagtgcaagaacactaaatgtggtgagtataggagccatgtgcaaatgcacaatgcaaattcctttttttctgcaagagaagaggatgaatatgatagatatttaggaagacttagtgaataatggcacttgggagcaaaggagaggaaagagccattccatggtctgagcaatgggaagccattctctgagtgggatggctgaaggggcatggaattgccaggagctaaagggatactgaggatgagcttagtttgagtcatcggagtctgcgtggtgttccacagtaactgcgtggatcagggccggagtcgtcttttttttttttttttgagacggagtctcgctctgttgcccaggctggagtgcagtggtgcgatctcagctcactgcaagctccgcctcccgggttcacgccattctcctgcctcagcctcccgagtagctgggactacaggcgcccgccatcacgcccggctaatttttttttttgtatttttagtacagacggggtttcaccgtgttagccaggatggtctcgatctcctgatctcgtgagctgcccacctcggcctcccaaagcgctgcgattacaggcgtgagccaccgcgcccagccagggctggagtcttaaacttgggagtggccagtgcagagatgggactgatgctatggaagcagatgaatttgcccaaggatggtgtgctcaatacagagagaagggagtttggataaggacccagaatcaggagcaggaagaagagtctacagagacgatcatgatgagaatgaccagagagaaagacggaaaccaagaacaggaggacacatggacaaacccaccataggagtggaggaacacatttgtctcaatgtgtccagcagacaactagttagtaaggacatagaagagctgaacgtgccagatctaatggacatgtaccatatatacatttacctgtcctcaaaaagatatgtatgacttactacaaaaattcaccacaaagtcgtgcacaaagcaaaatctcaactaacaccaaagacttgttattagacacattgtaatcaggttacctgactacagtacaattaaatttgctataaataataaaaagtaggccaggcgcactggctcacgcctgtaatcccagcactttgggagtcgaggcaggcggatcacctgaggtcaggagttcaagaccagcctgaccaacatggtgaaaccctgtctctactaaaatacaaaaattagctgggtgtggtggcacacggctgtgatcccagctactcgggaggctgaggtaggagaatcgcttgaacccaggagacggaggttgcagtgagccgagatcacgccactgcattccagcctgggtgacagagcaagactccgtctcaaaaataaataaataaacaaaataaaataaaataaaaataaaaaagtaacggaaaaaccctccatatatctgcaaaatttaaaaaatactgctaaataacccagggactgaaaaataaatcataaggaaaattaaagaagtctcagaactgaataaaaaagttactagacatcaaaacttagcgtatgcagtttgcctgcttatatgaggaagaaagactgaatttagtaacagcatacatcgagagaagtgagaaaaagaaaaaggaatttggaaggaaggaaaaaatggagaagagagcagaaactaatgaaataagaaacaaagcaatgacaagatcaataaatattaagctggttctttgaaaaaaaactgacaaaaataggcaagtctctggcagaggctgattaacaaagaaagaaaaggaataaattaaaatattaaaaattaaaaaagacataactaggcatagcatatacatgaatttgaaaacctaaacaaaatggacaatttattccagaaaagcaaaacattctaacatagtctcaagaagaaggaggaaatccaagtaacctataatccactgaatcagtacttaactatctactgactgcaaaagaaattaccaagccctggtgattttgtaacttttaccaaacattcaattcaagaaataggtaagtttaatcttctgcaaactttgttttcagagggaaaaagaggggaacacctcccagctcatctttctaggctagtgtaaactaaaaaataaaataaaattaggcaattgcagtatgaacaagggaaagcttgattcatataatttatgaataatgatgaaaaatctttaataaaagaaaagcaaagtagattttcataattatatgaaaatattgtgcctaagttttatcccagaaatgcaagaacggttccacattagaaatccattctacatgaatatatattcatgtagtttcatgtatattcactatattaacagaatacagttatatgtgtatgaatgtgtatatacatatatacacacacatatacacatacaaatacacacatgcatatatacttatctcaatagatgcagcatttgctaaaatttaaaactcatggcaaactcttagcagactggtaacaaaatgggattcccttcatctggcaaataatatttagtattagaaattttcagcaaacattattcttaattattaaactctttcctttaaaatcgggaacaagacaaggatggctactggctcaacttccattccattgtgttgaaagtcctaaccagtgcaggaagatgggaaaaattaagaatcaatgtgaagactggaaaagaagaaacaaaactgtcgttattcccagatgatggaaccctctaaataaaaagtcctaaacaatctacaggcaaactgttagagaataaaaaatttaaagtaaaaaaaagaatttttttttttttttgagatggagtctcactttttcacccaggccagactgcagtggcgctatctcagctcactgcaagctccgcctcctgggttcatgccattctcctgcctcagcctcccaagtatctgggactacaggcgcccgccaccgcacccggctaattttttgtatttttagtagagacgggggtttcaccgtgttagccaggatggtctcgatctcctgacctcgtgatccgcctgcctcggcctccgaaagtgctgggattacaggcatggccactgcgcccggccaaactaaaaaaattttaaactccctacttttccaataaggacaaaatgatatgacacctaggaatatatatttaacgtaagttgatcgagactgtatattaaaaatggtaacatttttattgaaaaacagaaggctaaatgaaaagctgtaccaaaaatgataattctccccagattaacctaaaaatacaatacagttacaatgatggtgtgtgtgtatatatgagaaagaaagagagagagagagagaagggagagagaagagagctctctctccatctctcttggaggaatgagaatggccaagacagttctaaagaggggaagagtggggatttaccctattaactacaagacaaatacagaaccagtatttcccgtaatgtggtaacaagagagacaagccatagaccaataaaaaaaaagagccctcagaaatagacatcttcaaatatagaaacagattggtgctgtaataattgatgactatccatacacaaaaataaatacaactagatccgtatctcacaacacacaaaattaaaccccagggggattactgagctcagtgtgagaggcaaagttttaaaacttccatgaaaatacagaaaatttttatcacttggggatggaaaaatagttcttaaaatgcaacactaaaaggacacatcatccaggaaatgaatttgcctgcattaaaactgaaaacttctctatcacaaatgatgcccaaaacaactttgagtgatgagtcactgatcgtgagaagacttttatgacaaagggaaatcgtttagagtaaagagcaaataactcagcaggaaaagagaaaaaaccagggagttagcagatcaaaacaaatagccatcagtcacacagaaagcctgaggacatcgagaagcaaggctgccttttccactggccaggagagcggggatccctgccatcgctgtggagtgcggtgactaaagtcctgcagatgcacttcccctgtgagccagcaagtctgcaggctggagaaaatgcagcaggtgcacacacgctgccgagtgcacatcactccgcattctagcactgttagaataatgagaaactgggaacaacccagtgtccatgaacaggagatggagaagcaacctgtggaatactcgctcaatgcaagaccatgcagaagccccacgaagatgactaaggcaacccttatctacatggatcagtatcacaaacctgatgggggtgagaatagaaactggcttacggtaccaaatgcgtcaactttgatgtaaagtttcagtgaagcagacaactctgcaggggaatgaaaaattccctgatgcctcaggatagtggctgcttctggacaatctctaatttcagacagagggagggacagagagccgtggcagtggaggggactcagatgggtctgcaacaatgtatgataatatatttcttatttaaagaaaaagaatagaagcaaatattgtaaacatagtaagattgaataaatctggaaggtattatattattctcatacttttctgcacgttgaactagctagtaacttttttttttgagacagagtcttgttctgttgcccaggctggagtgcagtggcatcatcttggcttactgcatgcagcctcaacctctcaggctcaagtgattctcctgcctcagcctcctgagtagctggaactacagccacgcaccaccacatccagctaatttttgtatttttagtagacacggggttttgccatattggccaggctcgtctgaaactcctgagctcaagcgatccgccggcctcggcctcccaaagtgctgggattacaggtgtgggccactgcacccagccactgacaacttttttaagggtgcagtgctcaactttcagatgtgccaggagatgcacagaacaaggacctgctgagggcaccgctggtcatttgcacggaaatgacccattggctgtcccctgctctgctgcgattcttcaggcaccacctagtctccgtctcctactaagcggatcaggttggaagtggaggaagcaatggatctggcattaaagatggaaatctggatctaccaccagttgagtctgcagctcagcccctgcacatcctggggcctccattttcccatctcctcatggaaatcatgaagtccgcctcatggacttcactgcggttggggtggtggtggagaagacagctcatgggatttgaaagggctgcataaaccagttcccaaaggatgcctatgcagcgaaaccagcccgggaccagcgcaaaataatactagtaggttttatgtctcccatggatgctctgctcctttgtccagtgccctgtcctgtggcccctctcactttggggaccatgggacatggagcctacctggagatcagaggttatttttaaagcatttggttatttcagggctctaaatgagtatcagaatgagagagaggagaaggcagtattgaacggtatgagaccatgggtgtggtggtgtgtggccgtagttccagctactcaggaggctgaggcaggagaatcacttgagcctgagaggttgaggctgcatgcagtaagccaagatgatgccactgcactccagcctgggcaacagaacaagactctgtctcaaaaaaaaaaaaaaagttattagctagttcaacatacagaaaatatgagaataatataataccttccaggatattgtcccagcatgttggccaggctggtcttgaactcccgacctcagaatatcaaattgctcagaacaattgtgctccactcccctgtgattataggattccctgctcagcttcctggaaccagtgcctatcggtttcggaatcacacccaatgccctccatgcatctctgaattcatgcattattccagtcctatctttcctgcctttgcttttgtcctttgttcttcccctgctcacttacctgtcatgaaaacttccaacagcttcactgaggtaaaactggcacacaacgaagggcacccatttgaagcatgagtctgatgagttttcacacagtacacattctgtgctttcatttgccctgctgccatttttaggtattcttttccacggccccttcttcccatggtccctttttatttatttagagacagagtttcgctctgttccccaggctggagtgcagtggtgtgatttcagctcactgcaacctctgcctcccaggttcaagcgattctcctgcctcagcctcctgagtagctgggattacaggcgcccgccaccacacctggctaatttttgtatttttagtagagacagggttttgccgtgttggccaggctggtctcgaactcctgacctcaggtgatctgcccacctcggcctcccaaaatgcagggattacaggtgtgagccaccacggtctctttattctagaacatctcatatggttcaatattgccttctcctctctctcattctgatactcatttagagccctgaagttaccaaatgctttaaaaataacctctgatctccaggtaggctccatgctgtcctctcccgtttgtttactcatccatctgcagcactttctccagtctggtgtttggcccccgaatggggcggtggagctcctcccgtactttctgtttggacactagagtgactggggtactttagagtgtgaaaatgggtctactaatatctatgctggaccatcttcgaccatgtggtgtgtgctaaccctaaacagaaccctctcctgagatcctgacacccagcctgtgctggcatggcagagaccacacagctggaaggaaggagggactgtctctctgtagttccttttatctgaatgtgctccgaactgtgggtccctgcattgggggaaggagggagtctgtatggcatagccatctgggtcccagagtctcccaagaagctgccctaaatcctgccacatcacagctgccaaaaaactccaaaggcagcacctcccttagtggtggctccagaatttcaactctgggactgcaatctggaaggaggctgtgtgtgcaggggaaggagtggtatcttaaagctgtgtttgcacagcacattgcattagaccttaaaaatgtccaccatccatttcaaacagtgggagcactacttataaaaattataaaggcctttagaacccaccctccccataaattaccaccggcaccataggtgattccacatctgacccatcaaacacctatcagtccttgttcttcaaaatgagggcatatttgagacctagtatggcttccagtaacctcccagaaggcctcataaagctgagttgaaagttgttctttctctttctttgttctggtcttatatgcaatatgtctggcagaaaattctagaacattctagaaaaatgcaagtgatgcattggccattaaggaagggtacaggtcttcagccatttttgtgtaggttttctgtcatttcagctaggattagaggtgaggtatgtgtatacatggccaaccatctgtgttcccattaccacatacctagagctgtgtttggtatcattcagcaatagaatcccagatttttttcatatattcccacttcctcagcttcttagatgctaccgttcttttcctatagctaacctacccgtatatcacccatacacactgaaaactgcatccgtcatcctactcaacaaaataatggctctctttcaggacagagggaaggattgaaaaaatttctaagttaatattttaatttcctgtcatagtgaaaacacaacatattacactgtcactgtctgtttttctttctttcttttcttctttttttttctttttgggacagagtctcactctgtcatccaggctggagtgcagtggtgcgatctctgctcacttcagcctcctcctccagagttcaagcaattctcctgcctcagcctcccgagtagctgggattacaggcgtgtgccaccacgccaggctaatttttgtatttttagtagagatgaagtttcatcattttggccaggctggtctcgaactcttgacctcaggtgatccacccgcttcagcctcccaaagtgctgggattacagatggaaaccactgctcctggccaactgtctgtttttcttgtctgtttcccccagtagacttggagggcagagtcagtgtctcttatctctgtacatccagtggccaacccagacacagaagaggtgctcaaaaattttctctgaatgaataaattaaaaactcttattgatttcaaaaacagttactgggtataatttgtgccacgcccctcgctgtaagccagaaaaagacaggagaaatgccgggcagtgaggaggccaggtcaggctggtgaccacagacatataagctgctcacccacaggctgtgcggtatgctccactggtcttgttgctcaggatgcaaacaaagagatagcagatatttgggctcatccagggatgcctgctagccagggaggcaccacagaaaagcagtatgagaaggagctctcacatactggtccagggatggctgaacaggtggacatggctcatgcatagagagaggggcggtatcgcacagtggagtctggctgaagctggacagcactcaccatggggctgtgtgaaatattaataataagatatgtattatgtgtctttggtctctgctcctcagtccctgctaaagagctgctaaaatccttgtcacttcctgagtgacaggggcactaggtaatctttttgttgttgtttatagttagtttttctttctttttttaattatactttaagttttgggatacatgtgcagaacatgcaggtttgttacatgtgtatacatgtgccatggtggtttgctgcacccatcaacacatcatctaggttttaagccctgcatgcattaggtatttgtcctaatgctctccctccccttgcccccaccccctgacaggtcctggtgtgtgatgttcccctctgtgtccatgtgttctcactgttcaactcccacttatgagtaagaacatatggtgttgggttttctgttcctgtgttagttttctgagaatgatggtttccagcttcatccatgtccctgcaaaggacatgaactcattctttttttatggctgcatagtagagaatcttctgttttagtatttggtgtttgaccccagctcctaaatcctttggaatttcctgggtgataggagtgtcttttgttctaatgaagcgactcttgatggaattctagatgggtgctgggtcaccagaatgaccaagccatgatgacgagcttggggctttcagccccactccccattctccagagaagggacagaggctggaaacggagttaaaaatcgatcctgcctacatgatgcagcttaaataaaagtccctgaacggaggggttcagagagcttctgcgtcagcgaacacatccccatgccaggagggtggcgtaccctcgctcctcggggacaggggctcttgtgctcaggactcccccaacctcgccacatgcatctctccacctggctgtgcacctgcatcctgcctcatatcctttataatcaacaagggcatggaagtaaagcctttccgtgggttctgtgagccactctagcaattcaatcaaacccaagtagggggttgtggaagccccagtttataccccattggccagaagtacaggtcacaacctggggcttgtgactggcatgagaagtgagtgtggtcttgtggggctgagcccttaacatgtgggatccaacgctgtctccaggtaaagagtgtcagaattgagttgaactgagcacacccagctggtgtctgctggagaatggtttggtgtatgggggaaatgaatacatctggtgtcagaagtctcgtgctgagtggtgtgtgagagtagagcactggaggctggaaattgtcttgctttttttttttttttaactttcttagagacaaagataagaaagcacataaactcaataactgattgatttcttgggaaacttttatctccttgtccattgataaggtttctctgggtaatttggtttattgtggctcagtaaattaaaccaggtacatgaaagaagaataagatctttaactttgatttgaattaggtcactataataaaagcataaggacattgttgaatacagcaaagcactaaaggtggctagatgcagtgtcaacatgttacgaagcatatttcaccagttaacagttctgatttttgtaacttaaaaaaaaatactgtgaatactggtccaaaaatatgtcacagtcttgcgctgggtttgacttggcaaaaatggccatcaatctacctaaacatctttttattgtttaagcatttattatgtcattttttgttacaaaagccgagacactgtttcatcaggaacgggggtctgtagccttgctttttcagtagcacttgtccatcactgtcaaaggctttgagaaggcagatactgaaatcctaatttttagaccctatttcctgactattcataatgagatgcccagaggcaggccctgtcatcgggaagcagggacatgggtcctggagggctgagacactcagatggtccctgccctccaccaggacctgctcaggaacccaggaggagccacctgccctctctctgggctgcagccttcacacctgcaccatcggtcaatggaccccaggatgcaccctccctctggctctacaattctgtgaatccctgtgtggtgtggtggagttccaggtcccctctgtgccctctgccctgctcctcgctcagccccataaggaggtaagaaaccatcaatatcctcaagagagaggcttgttggcccccaggggttctctgctaaaaaaaaaaaacagagaatctaggagcagggccagtcaggaagggcagaacagagatccaggggtttcggggcctccaaaccaacaaaagacaatccgagggatgagtgaagcaacatctgcatgctcttctggattccaaatttattcctcctcggccatgaagaaagttggtttctgcttttttccctgaggatgggctgtgcctgtacagccttccaggtatgggaggggaggaaggaggggagggtgcctgacaggaagcaagtagttggacaaatctcattaagtcagtatcagttaattcaaacacaactaaaatcaaagtgctttgattcccaagccaattatataggatttcccccacataaattgagttcattacatagtaagtatagataatccataatttaatatggaaaattcagacatggagtgttactaatcagataaacagagcctcaaattagactatggaaaagatcaatggacctgctctaattgccaaccaaaaagaagcaagcaaaagggaaattaatcaaaggaacattctcctttgctccttctttagctaagcgtcaagaacattttgcaggtgataggaaggggctgtcctggatatccgtgcaaaagagtagagcagcctcttcccagagtggctccatttccaatggcccatatttgttctgctgcccaagagttttaataaagcaacaccggatccctgcagaagatcctttcactgcagtcaaagtcatcaggcacagcttggcttggatgacttttcaagagtaaggattatattaaaaatgactgcaccactaattatgagaaaactagataatgtggcacatgactctcagaggaagaagtatctataattatgggaaggaagtacaaaatcttaattatgctaactatttaaatagagcataaggcttgagatagaatttaagggttaggaatctgccttagtgctttgaagtatccatatacttcagaaaagggatctgaaaaagatataaaatacactgaaaactccactgtaattaactagctagagacatccatgggtgcaaaccgtaaccaaggagagaaggctgctgcaatctcagggataaaaacgaagacacaagggctcatggaaaaaaaagacaaagacagaaggagccgaggagggagttgccaagactcaagatcacatcgcaagcagaggaaaaaggtaatgcctgctgcagaaaacagccaggaagagaagctttacaaaaaccgaacagggataggggcagtggctcatgcccataatcccagcactttgggaggtcaaggcagcaggatcacttgagcccaggagttcgagaccagcctgggccagtgagatcctatctctacaaacaataaaaaattagctgggcatggtggcatatgcctacagtcccagctacttgggaggctaaggtgggaggatctcttgggcccgggagtttgaggctgcagtgagccgtgatcacgccactgcactcaacctgggcaacagagtgagaccctgtctcaaaagagtttgttaagtcattcatgctacatttccaatgtgggtagggtgcaggacgctctgttcattgtagtgacccaggctgatggcactgccatcacctctactctgccaattactgtgccagtgggaaagagagctctggaagacctcaaaccacatttaaacattctgacttgaaagtggtacatataagctttgcttacatggcccccagcaatcatgaggggacagggaagtacaatcttaccatgtaaaaggaagttggagagctagacatgttttaaaacagcattaatgaccatcacatacctaaaggggagaaagcatttggctgactttcagatttttccctatacagatattcaatgcaaaagagaataacatatcatctataaacccctaagagaaagtttcctcaagaattctgcacccagggggaaaaatgatgtagaacattattccagaacattattccagattctgctgaggatggagaaagctggaaagaacattgccccaccattacaacaacaagaagaagacattgggttctgcaaattcccaacttaaggtgaacccatcagacagctgaggtcacaggacagcaaattctaaggaaaagacagagtctccaaggagagacatgagcacttacctggggcgtatgcagtcagataccagctctagtggaaaaggtggacaagatggaagatcactgaggtaaggtagcagagaggtggaagcaatgaggaagagtcaaatgcaaatactaggaattaaaaacaggcacagagatgaagaatgcctttgatagacagggtcggcagtggactggacacagttgaggaaaaaatgaccaagtggggtttatcttgggaatgcaaggctggcttaccactcaaaagtcagtgttattcaccatttgagtggactgaagaagataatgtatagcaacatctaagcagacgtagtaaaagactgataaaattcaacagccattcgtggtattaaaaacaaaacaaaaaccactctcagcaaactaggaataggagggtacttctacaacctgataataaacatctatgaaaaacttagcgctaacattatacttaatccctaaaagcaggaacaagagaaggacatctgttctcaccatatctattcaacactctacggggcggtctagtcagtgtaataaaacagggaaaagaagtaaggggcatccagattgcaatgtgtgctgatttattttaggtgtcaacttgactggatgaaggatactcgagaactggcaaagcattgtttctgggtgtgtctgtgagggtgtttccagaggagattggtgtgtgagtctgtgaactgagtggggaagatccaccctcaatgttggggggcaacatctgatcgtctggggacctggatagaacaaaaaggcagaggaaaagcgaattattttcttttgctcttctggagctgagacaccctttcctgcccttggacatcagaacttcaggctctctggcctttggaccctgggactcacactggtgcaaccactccccgcaggttcttggccttggactgagagttccaccattggtttccctggttctgaggccttttgacttcgactgagccaaactcccagctttccagggtctccagcttgcagatgggactgtcataggacttcttagtctccatggtaatgtgagcaattctttcaataaattccctctcacctatctgtatctgtcctattggctctgtctggagaatggaagacgtaaaattgcctctctttgcatagcacatgactgtctacataagaaaacccaaagaatctgcaaaagagctaccagaactgagtttagtcaagaccacaggatacaagattggtaacaaaaatcaaatttctatgtgctagcagtgaataagagaccattaaaaaataccattaggatagcaccaataaatgtggaatactttaagcataactattacaaaatatgttaagatctatatactgaaatttacacaagactgatgaaaaaaagaaacactgaagaaatgaagtatgacttaaataaatgaagaactagatcatgaatatgtcaagtctcttcaaagtgacatgtggactccatgcaatctcaattaaaatcccagcaggattctagtagaaaatgcacaagtggattctaaaatttatatggaattacaaaggaaatgatagctaagacaattctgaaaagcaacaaaattggacgacagcaataaacagatactcgcttccaatagtccctggtcctcttgatctcagatgaaagtcagtccctgccaaggctgttgctccttgcataggccctcaggtgggggacaggggcaggctgcctcttctcctagcacctaagccactgctgccacttccagaccattggcctcacaccttaatcacaactcctgcctcctttgagcctcctgccaccagttttgatagttcctatctctaagtaggctttgtacacaaattcatgagggagtttaaaatagtgtagtctttcctttgctttcaactcttaccagtgtcctgggcaatctgaatacccatggggatgtgccatgcattcagctaggctcccagccttccctggaacttcttgacttcagtggcctttactctatgccgtttttgccacctcataccaagggcttttctcaccaatgtaccagaacagtgaataagagtgagactgcaaggtcaccagctccccctagacctgagactgcattcttagagacagtgttgttttttcaccagcattacctttcaagccacagtcactgctgcaggggctggagagtcatgaaaaccgggtcctgcatcccatgagtgaaggcgttcaagggggacgccaggaccttagaggagcctgttgaacaccccaaccagccaactgaggaacgggaggtaacgtgaggcccaaatgcatccccatactcaagaaaacattcccaggttgaagaagtgacttagcagttgtcagaatgagatcgcagagtgagcaacggctgcccgtgtcccctcccaggagggctgtgaaaggccacagcagacctcaggcactgacccaggcaggctccaggatgcagtgaggtagaatgtgggcgtaggtaatgtgggcagcatgaaatacctggtcccatgatgggatgggccctggagtgctgcagttcttgattcctccaaccccgctgcatctgtcactctggtgagctgctgggaccatccaacttggaccattcctccgtgcaaaacatgacaggcgctgtgagccaggcgtagtcctaccatggagatgagccgcatcctctctctctgtacatctttgcttgtctaccagccggagaccacccatggaggactaatcacaagcactcaaggtcaacgctttcctcctctccccagatccgaggtggctctctgcagtttcccatcccctgcatactgcattccctacacacatgctagaaccccctccatactgcaaacacaattttaccaccaactaagagttccttggactgtgccacatctttttatatttatttatccatttttttcttttgagatgaagccttgctctgtcaccaggctggagtgcagtggcacaatctcggctcactgcaacctctgtctcccaggttccaatgattctcctgcctcagcctcccaagtagctgggactacaggcgcccaccaccacacctggctaatttttgtatttttagtagagagggggtttcaccatgttggccagactggtctcgaactcctgacctcaagtggtccggctgcctcagcctcccaaagtgctgggattacaggcgtgagccactgcgcccggcttgtgccacatctttttaaaaagttttggcacagttttattcaggggaaacagaagaattgggttcactcttcttatgtatttttaagtagccaattttgcttttcagaataaaacactcggaagaaaaaataaaataatataaacaatttttccaaatcactttttttttaaacatcaaatgctacacataagaatagactcccaggggagactgtctgatttttttcctccaaatatcttttaaaaagcaaaataaatccccatttgttccctgatggtataacagccaaaaatgtcagaaaagccgtagaatgatcccatcatcatttgtaaagacctctttcaaccatttgcatccgaatttgcagatgtcagaggtaggacaatgaaatggcaaaaatgcaaagtgagatccagaaagcaacactttcaaaatcaaaatatataatcctttcaaatgttctctggaaagatattccctcttgcactgaacctaccccgggaagttaagagctgaaaggaatctatatgttaataaggcttcctaaactgtctgtaaggcatggaatgaaatgcatgcacaagcagcgcccagcggggtcaccttcaaggtcagcctcacagcgttgcagttctcctgcagcgggttcagcttcagcgtctccccgaggttgctgcagccggacgactggtgctgcagctcacagcagacacacacctccacactgtcaaacttaatctagacagaggaacacagacagacctcaccgttaacaggcattcgacccccgagggtacgcgtgagtgacacagttcagaacacaggaaaatggctcagttcaaaggagcctgtttcagtgtgtttaagtagtacagcaaaaacaatttctattgacccaggccatcaggaggacttcaaattcctatcttaacagcaatgtatagaaaaagcaaaagtacatttgaagaaacttaagctatacattagagaaaatggcaggtggattacaaaatgagataaaggtaaatagattgaaagtcactcatgctgatgtatgcacggagatgtgctatcctagctctgtgccttggctcattctccttccacagtcagaaatttcctgcctcacttcatggcctatcaaactcctgctcatccatcaagacccaactccagcgccaccctcgaggccttgtctggttttcctgcctcactgctactgaagactgactttatccagctacaggtgcatcttatcaccacagtattgacaatggcaacaagttgtaggtgttcaataaatgctgaatgaataaaaacggcttggaaaatggaaaaccatggaagaaaaaaatgcatttcaagtattttaaaaagcagtgttagacgaagagagagtatgagagtctcagtgagagggaagagaacagagttaccagtgcctaggagaaaagcagctttaaaaaagtaaagtcctagccaggtgtggtggtacaccacctgcatttgcagctactcggcaggccagggcaggaggattgcttgagcctaggagtttgagaccagcctggctgggtaacatactgagactctgtctcaaaaatacgtaaataaaaaataataaagtcctagatgtaaaactactaaaaaagaaaatcaggccaggcgcggtggctcacacctgtaatcccagcactttgggaggctgaggcgggcagatcacaaggttaggagttcaagaccagtctgaccaacacagtgaaaccccgtctctactaaaaatacaaaaattagctcggcgtggtgctatgcacctgtaatcccagctactcaagaggctgaggcaggagaatcgcttgaacccaggatgcggaggttgcagtgagctgagatcatgccattgcactccagcctggatgacagagcaagactccatctcaaaaaaaaaaaaaaatcagtaaaatctatgcaattttattcaaaataacactgaacatgaaacaagttattttccttagactaagaagtgccctgctttccaatagataatatgtttacagcagccaactcgaagtacaaatacttttcagacaaatattggccatttataaccataacaaataatttttcattgcatgaatattgctgagactgaggccatacttataaaacctccaggtatcaacatgtccgcctctcctaaatactgggggaggggtaatggagcatcctcagagccaagaaatgtgctgatattcaccagaggaactcagcttagcttaagacttagcccctgccaccccctgctccatgtcaggtgggctttgcgagtggctttcagcaggagaatatgggtagaggtgtcagcttgcagcttctgaacttaagacctccacaggcttcatgtttctgcaccctctccctggaacttccaatatacagcaggaaaagaacagattccagggagctgccagctctccagtcccagcaggaaacccgtggagcacccctgcagaactgttctgccctatggtacatgcacacacaacattactaggtaagatcaaaccatttttcaaataattcaaacaaattatactcccaccaatagggtgtgaattcaggctaatccacatcctcaccaatgcttgctaatgttggacttagacatttttgtccatgcagtaactaatataatagtatctaatttgggggtgggtgggtttgttttcatctttcctcattttcttaaccgttcatattgtgaaacctaacacacatacacaaaaagtgcacaaagcaaacatattcagttcaatgatttatcattaagcaagcacccaccggcccatggccatgttcctaaaaggccttccatgcctcattccctgtcattcctcccacttgctgcaccaaaagctcaccacattccttactttttaaataatcacttctaggcttccacctttatacatttaccactatagtttagtttcacctggttttctaacttgatacaaatagaatcatacaatatttttagtatttggcatctttcattcaaaattacaagattcatctaccttactgcatataaatatagttgatcatgttcactgttgtatattacattgtgtgaatatgctgccatttatatatctattctcttgtcacgggacgtttggattgttgctaatttttttgcaataagattaatgctgtttgatattctgtactagtctgctggtacatacatgtgcatatttcttttgggtacaaaatacctattgatcagagctgctgggtccctggggattttcagctttagcagagaatacaaagccactttccaaagtggctgtaccaatttacacactcaccagcactgttcgagggtccccattactccacatcctggcttgtgcttgttttagtctttttaattttagataagaaagtactggaagaggtacttcttccttgaaatgagggactaagccaagaaaaaaagggaagatgggatctaacacagaaaagagatagaggaagttctaagagaatgggaaaaggatgtcctagcatggtaaatatatagactgcctataggctgacttgttcagactgaagcaggaaacaggctcaatggaaacgtctctaagaaaatgaagctgacagaacgcttgatgggtaggactgtattcagaggagattttcagttctcctgggaagtttgagagtaaattaggaacagagacactaaacaaataataaaacaattttaactcagcataaaagacaaatcatatatagtacatggttttgttatatatgcggcttgtaaatattttctcagtctatagtttatctttttatcctctcaaaaggatcattcattgagtaaacgttttaaattttgatgaaggccaacttacatatttttgctcctacacttttggtgttgatctaagaactctgcctagccctagatctttctcctatgttttttctaaatgttttataattttatttttacatttgattgcatgacccattttcagtcacttttagtgaaagatatgagacttgggatgaggttgactatttttgcctatagatgtccaattgttccaacatttgttgaaaaatctatcttttctttgcttaattccttttgacttttgtcaaaaattagtcgggcatatttgtgtgtctctatctggattctctctttgttccattgatctatctttccaccaaccaccaagtcttgattactgtggctataagtctggaaatcaaaaaattaattcctcccatttaattcttatttttcaaaattatttgtctctccatatacattttttttttgagacaggtcttgctctgtcacccaggctggagtgcagtggcaccatctcagctcactgcaacctccgcctcccgggttcaagcgattctcatggctcagcctcccagatagttggaattacaggagcacgccaccatgcctagctaatttttgtatttttagtagagacaaggttttgccatgttggccaggctggtctcgaattcctggcctcaagtgatcctctcacctcagacttccaaagtgctgggtgtacaggcgtgagccaccacacctcgtctccatatacattttagaataagactgtcattgtctccaaaaaaagtgttgctgggattttgatagggattgaatcaaacccagtttcttttttttttttgagatggaatttttgctcttgttgcccaggctggtgtgcaattgcgtgatctcacctcactgaaacttctgccttctggattcaagcaattctcctgcctcagcctcctgagtagctgggattacaggtgcccgccaccaggcccagctaattttttttgtatttttagtagagatggggtttcgccatattggccaggctggtcttggactcctgacctcaggtgatctgcctgccttggcctcctgaagtgctgggattgattacaggtgtgagccactgtgcccagcccaaacccacatattaactggggggaaatggacatatttactacattgaattttccaatttatttatttcctcattgttaacgcagttttcagtgtatgttttgttagatttacacttatgtatctttttaagcgatttttaatttcagtgtccatatgctattaatatgcagtattactgttactatacagttcactattaatacacaagaaatacaattgaattttgtatgtttatcttgtatcctacaactttgctgaactcacttattaattctaagaggcttgtttgttctgtttgttttttaaagattctttgggattttctacatagatactcatgtcatccacaaacagagttagttatatttgttcttttctaatctttatgccttttattttattttcttgccatactacattggcttgaaattacagcattatgttctatattgaaaaaaatggtacgaatgagcatgcttgccttgttcctgatcttaggggaaaagcattcagtctccattaagtgtgttagctgtaggtcttttgtagatgctctttttcaagttgaggacgttctctatgcctatttttctaagtttcctttttagttatgaaaaggtgcttgagtttgtcaaatgctttttctccaacaattgatacagccatgcagtttctcttctttagcctgttgatatgatagaataaattgactgatttttgaatatcaaaccagttttgaatccctggaataatccctcttggcaatgatgtatataactcctttcagatatgttgaattttattcgttattattttgttaaggatttttgtatctatattacattaataagggatattggcctgtaattttatttttctatactgtctttgtctggattttggtagcatggcaatattactttcacaaaaatcaatttggaaatgttccttctattttttcagagaaattgtgtagaaatggtattaattctataaatgcttaatagaattctccagtgaaaccatctggacctggagattttgtttttggaagttttagaattataaattcaatttccttaataattatagggctattcaaattctctacttcatagtgtacgagttgtgttagttcgtgttttccaagaaattgatctatttcatctaagttgtgaagttcatttgtgtaaagccattcctattattcccttattatccttttgatgtctgctgggtctgtagttatatcccggtttcttcccagacattgggaatttgtgtcttctaactttttttcttgctagagttttgtcaatgttgttgatgttgtcaaagtatcagctcctttttcattggtttttctccattggttttctgttgtccatttcattgatttctgctctttcatttatgatttcctgacacctatttgctttgggttgattatgctgctctttatctagtttctttttttaattttatttttagttgagaaataattctatattacatatttatggggtacagtgtgatgtcttagtaatgtttacattgcagaatgattgaatcaagctaattcacaaatcacctcccattttaaaaattttttttattttactttaagttctgggatacaggtgcagaatgtacaggtttgttacataggtatatatgtgccatagtggtctgctgcacccgtcaacccatcatctaggttttaagccctgcatgcattaggtatttgtcctaatgttctccctccccttgcccccaacccctgacaggccctggtatgtgatattcccctccctgtgtccatgtgttctcactgttctactcctacttatgagtgagaacatgcagtgtttggttttctgttcctgtgttagttttctgagaaagatggcttccagcttcatctacatccctgcaaaaggcatgaacttattctcttttatggctgcatagtattccatggtgtatatgtgctacattttctttatccagtctatcattgatgggcatttgggttggttccaagtctttgctattgtaaatagtgctgcaataaacatacatgtgcatgtgtctttgtggcagaatgatttataatcctttgggtatacacccagtaatgggattgctgggtcaaatggtatttctggttctagatccttgaggaattgccacactgtcttccacaatggttgaactaatttacactcccacaacagtataaaaccgttcctaggccgggcacggtggctcacgcctataatcccggtactttgggaggccgaggcaggcggatcacgaggacaggagatcgagaccatcctggctaacatggcgaaaccccgtctctactaaaaatacaaaaaattagccaggcgttttggcaggtgcctgcagttccagctactggggaggctgaggcaggagaatggcgtgaacccgggaggcagagcttgcagtgagctgagatcgcgccactgcactccagcctgtgtgacagagcgagactctgtcttgaaaacaacaacaacaacaaaattgttcctgtttctccacagcctcaccagcatctgttgtttcctgcctttttaataattgccattctaactggcatgagatggtatctcattgtggtttttgatttgcatttctctaatgatcagtgatgatgagctttttttcatgtttgttggctgatatatttatctttttgtggtgaaaacatttaaaatctactcttaagcaattttgaaatatacgaggcattatttattttagtcatcattttgtgaaatagatcactaaaacttactccaatctaactgaaattttgtaccctttgatctatatcctctttggcttcaactgtttccctttgctgtgatcaactggacaggagtccagctctcctgaaacagttcactctcccacgtctcaaaaacattcaaggaattatctcatatgatcacatctctaggctaggcattaagattgaagtagctatcataaatggcaagacattttcctcagtctgaaggatcatccggggaaagggaggggagatcagcttgtctggaaagcatgatttatcaaataaaataacccttcaatgaccccagggaatagacatccaaataaatcttttccatcagttatttcactgagtttgtgattaattcttaggaaaattctgaaaacctcctggttagttccctgacctcgacatctgggtgtgcaggcggctgacagatttattttaagagtacccctcagtgttcgggtcattgggaacgacaccgcagagctttgcaaatgaggccacagtaatttttcacaaatctctttggggcacttaacagctagcctgccccccttatttatggtctatcagcctgtctgggagtagaaagggcttatacaacaaaaagagggggatgcccccacgattctcttacagaagtacaaatgggatgggtatgtgaccttcagatattctcaaagggaaggcagtgtgggaaggctgagcatgtaggcagagcagggcagagggctgggaagaggctggcatgtgtcaagcccgagaacttacagtgggcacaccaaggccagtatccttggatgtgaggagcctgtttcgaggaggaaggaggcgcagcacgggtgacagagtcagactactcacagtcctaactgccatggagtgacccaggacaagccatgtgacctctctgggcttcaggttcccggaccccagtgaggatcaaatgagattagacaggtaaaaatgcagagtgccaacgctatttgccggtgttattgatgttgctattatttacattaaagaaaaaatttgtagaaactagaccctaagttttcttcccaaaggttcaaacaaagctacaaaaactagaccctaatttttaaattgtggtaaaatacacacaacataaaatttaccatcttcaccatttgtcggcatacagttcagtggcattaaacatattcacctcgttgtgctaccatcaccaccatccacctccacaactttttcatctttccaaactgaaactctgtcaccactaaacaaatccccattccctctcccacaggcccccaacaactcccattctactttctctctctgtggattcactactccaggtacctcctgcaagtggaatcaggcagtatttgtccttttgtggctggcctatttcactcagcatgtcttcaaggttcatccatgtggtagcacgtgtcgagatttccttcctttttaaggctgaagaatgttctatcagatgcatctaccatattttcttgataattcatctgtagatggacacctgggatgttttcagctcttggctgctgtgaataatgctgctatgaacatgggtgtgcacatatctatttgagtccctgctttcaattatttgggtaaattcccagaaggggaattgctggatcatgtggcaattctctgtttaatgatttaagaaaatgtcataatgttttccacagcagctgtgccattttacgttccaccaagagtgtacaaggcttccaacttctctacatcctcaccaacacttattttctgggttttcaaaaaatcatagtcattgcagtgggtgtcaggtggtatctcactctggtttcgagttgcatttccctaaccattagtgatgttgtgcaccttttcatgtgcttactggccatttgtatatattatttggagaaatatctattcaaatcctttgcctgttttcaaattgggttgtttgtgttcttgttgagctgtaggagttctttatacattccggatagtaacctcttatcaactatacaattggtaaatattttcacccacggagcctcttctgttgattgtgttctgtgatgaacagaagtcaattcaactttttgaatacttgtaggtttccatcactttcacaaaaactgtcagtaacctgttgatttctccctaacccagtaatttttgcttcctttgtctcaagaatgagccaccttaagtcttgctgcagaggtaagcatctcacttgcctcactcagtccttgtcctgctttctgagcaatgccactgtcctgcagcatccctgctggtggtgggagagggtccccacaacaccagccccaatgacacaggacgacataactgcctttctctggactactattaacaaataccacagacggggtggcttataaacagtagaaatttatttctcagagttctggaggctgggaagcccaggattaaaacaccagcagatttggtgtatggtgacatcctggttcacagatggatcactgtgtcctcacctggcagaagagacaaggcagttttctgggacttctattataaaggcactaacccactcatgcgggctccacccacatgacctaatcacctcccaaggaccccacctcctaataccatcaccatggaggttagaatttcaacatagaaattcgggggtgggggacacaaacattcagaccacagcaaaaacccttatgctggtgatgctcaaggcacttaaaggcactggtaagaccccaaaaactccagtaatcacagtgcaacatgggtggaccctgatgacattatgctaagtcaaagaggccagataccacagatcacaccccgcatgattccattcaacatccagaacagaaaaacccacagggacagaaaccagcttagcagttgtctgggactcagtcggggacaggggccaatccggggtgcgacataaagggtatggtatgtttttttgaggtgatgaaaatgctctaaaattgactggggtggtgacgcacatacggtaaatatactaagaaaacactgaattttacactttaagtgggtgaattgtatgatacgtgaattatatcacaataaaggtgtttcagaaaaaaattaccaccacacgtaattactaactcatttagtttggttttaatcccttccgtgttctgcctaaacgttttatattcacacacgtgtcaccaacatcgacagtttgggaccaatcaaaactaccttcaccactgtctccccggcataaactcagggccaacatagacatgctccgtaggttggatgacacggagccactttcccgcgagtggctcaaagctactcgccaagcagctcctgcagcagtgccctcagccagcccctccagctcttccttactccagagcatcaaggactgggcacctttttgttcctggagagatgctgaatgcagtccctgccagacctgaggacaaagccggcccattattggggtgtttcccctgtgctacacactaggcgtggaagcatttggactggcattgtgtccagaattggttcccgcccgtggcttcctggtctcaccgacttcaagaatgaggccgcagacgttcccagcgagtgttacagctcttaaagattgcacgaacccaaagagtgagtgataacaaagtttattacgaagagcaagagaacagatcttccacctcctacgagcggtgtgccgctgccggttggggggcggggggggtggccagcttttattcccttatttgtccccgcccatgttctgtttctgtcctatcagaatgcccttttctcaatcctcccccacgattggctacttttagaatcctgctgattggtgcattttacagagcgctgattagtgcattttacagagcgctgattggtgcattttacaaacctagctatagggtgctgattggtgcgttttacaatcccctggtaagtcagaaaagttctccaagtccccactccacccaggaagtccagctggcttcacctctctcttccttactccagagcacgagggactgggcacctgtttgttcctggagaggtgctaaatccagtccctgccaggcctggggacaaagccagctcatcactggagggtttccctgttctgcacaatgggcgtggaatcatgtggatgggcgtgtcactgagggatccccccagcctccccactaggttgggaatgcagccatcagtgggggtcaccccaccttccctgccaagctagggacacaaacccccacgctggcccctcctagcctgtagcccccctgtcccctggggggcttacaaatgccgggacttctgagaactgagactgccttttgtgtcccctacagcagggatggcaaacacagaccacacatcccaccatttccctcttttgctttcaccctcccctccccccaccctgagtccagataacagccttagaatcctactcaacacactgttctgggcacttaatgccaggcagaggaagctggcacacaacgtgaaacctacttgccatccctgtcctacctataagtagatagggccaaaaataggagaaaataaaatgtttatgaccaaatacataaagacattgtaaaatgttgatgcttgctaggagggaattagctgactccttaaaaacatgtgtcatctactttgaaatgatcgagaaatgctggcaaatagggcagcctcagagtgctctcaagcctctgcccagtggcaggggaagcaattctctctgtgcttctgcaggaagcgacagctgaggtttgagggaggcgccagcacaccacagatatcagattcctcagtaaacagaactcacatacacccctggtgggagtgaaaattaatacgaacaacttcggaaaacacacagtttggcagtatctaccaaagctaaacatacctatacctatatacctataggtataccctacatcctataacctacagacttcccctctggtgtaaccaacagatggatgttcatccaaagcaatacacgagaatagccatgcctgtgtatccacaatagcctcacactgggaggagagtggggaaaacaaaactgcgaggtactcacacaatggaaaattggaaaccagagctacttgcaacaagatgagtgaatctaaccgacatgttgaatgaaaaaagcaagaaataaaagggtcaattacatatgattctatttataaagctgaaagccaggaagaattcttttgtgacattagaagttaggatagcaggtgcccatgaggagtgtggtatgagtgactgggagaaggaggggcggggctcccggggatgctggagatgttttacttctgatctaagtgttggttccatgggtttgttcacctgtcaagagttactaggttcagtacttacaatgtgtgctttcttctctggctatgtctgagctaacacagaggattaatttttaaaaaatacacaaatctgtctggtcgtggtggctcatgcctgtaatcccagcactttgggaggccaaggtgggcagactgcctgaggtcaggagttggagaccagcctggctaacatcgtgaaaccccgtctctactaaaaatacaaagattagctgggcgtggtggtgggcacctgtaatcccagctacttgggaggctaaggcagggatatcacttcaacccaggagtgagaggttgctgtgggccggtatcaccccactgcactccagcctgggcaacagggagagactccgtctcaaaacaaaaacaaaaacaaataaaaaatacacagtagtccaggggagagtctgttgcttatgactgagtggacctcaaggcctgcctcagtttcccacagagagagaaggaccatggtcatgaggagaccttccagggatggtggaagcaaaagagaaagttgcattttgattttggttcctccgcctggaaagtgcgggtctcacacagggaaaaggtgggcttcttccaagactcagcctgagcatctccctctgctctcggggactgagtttccctcttcctgtgagtctctctgtgccctggtacccctgcagggtcactctacccagctgtcaccccctcagagcacaaactgctccctggcatcgggtggctgctcacaactgactctgaaattagtggaaggatgtaaaagtaaaaagttggatgcaaaagtgtcacctgggttaattcaactggattgtaaaggtttcaagaaggttttgtataatgctttttactttctgcattttaagatgctttgacatcttggggtctactaatccaggagagactgccctcccagggctagctaattccttcagataataagaaactcacctgcaagcccacttttcctatgcagaccaaccaatccacagcccacacctcgaactacacccttcatttaactctcacaactaagccactatttcccctgccctaaatcatcccagggccaggtaaggtactagacaactgggggctactcctacagccaacaggtcaaaccagccaattctcacctgggtcaaacgtgcctgcacattcttccccacaaaaaccacaataaaggatctggcccatgctgtcccctagatcaggggtccccaagccctgggccacagaccagtactggtccttgacctgttaggaactgggtctcacagcaggaggcaagcagtgggtgagcattattgcctgagctccgcctcctgtcagatcatcagcagcattatattctcataggagcgcgattcctattgtgaactgtgcatgcaagggatctaggttgcacgctccttataagaatctaatgcctgatgatctgaggtggaacagtttcatctgaaaccatccctgacctggaccctcccccagttcatggaaaaattgtcttccacaaaactggtccatggtgccaatatggttggggactgctgccctagatccctctgagcttctctgtgtggtcttgcctgggtagcatggcccttcctcttggaaactgcgagtaataaactcttctttcaaagcagtggtctctgtgtctggcatcccaccgtaatggactacaacaaatcccaggtaccttttaagataggcttgcaacttaaagatgatacagccttctctaactatctcttatcccaattcatctctttcctatgtatattttcaatagacacctgtgcttcaaatgcattaagatacgtcccagaatgcaatccatgggtatgaactgtgcaggtaccacatgttactcctaacacttaggatcagatgattaatagaaggggattgtctgtaaaatatgcagttattcaggttactacataataatggaaagagtaaaaaatcaaattatttcttcagtcttttactacgaagatttctgcattttgtttttgctactgctataaatgagggaggcctcatttgtcctatagtaaaatgatgaaaatctgcccatcatcccctctacgatgaagccagtggagagtcatggtgttctgtgaccgtggtgctgtgtggcagagtgcactcaaccacctctcagacacactcgatgtgtgccctgcagccctgaggctgctccacaagcccctcccagcatgacccagcccctgttccagtgacttcagatctatgtctcacttcacttcagaattctttaggacaaatcgttttcagaatatgggaaattactttcccttgtctgattgccctggctaggacttcagtagtgtgttgaagaggagtggtcagagtgggcatccttgtcttgttccagttctcagaggggatgctttcaacttttccccattcggtattatattggctgcgggtttgtcatagatggcttttattacagtgagatatgtcctttgtatcccgattttgccgagagttttaatcataaagggatgctggattttgttgaatgctttttctgcatctgttgagatgatcatgtgatttttgtatttaattctgtttatgtggtgtatcacatttattgacttgcatatgttaaaccatttctgcatccctggtatgaaacccacttggtcatggtggattatcttttgatatgttgttggatttggttagctaatattttgttaaggatttagcatctatgttcatcaagaatataggtctgtagttttcttttttggttatgtcctttcctggttttggtattagggtgatgctggcttcacagaatgaattagggagggtctcttctttctctatcttgtggaacagtttcaaaaggattggtaccaattcctttttgaatatctggtagaattctgctgtgaatccgtctggtcctggacttttttttgttggtaatttttaaattgtcatttcaatcttactgctggttactgttctgttcagggtatctaattcttcctgccttacgctaggagggttgtatttttccaggaatttatccgtctcttctaggttttctagtttatgtgtgtaaagttattcacagtagccttgaatgatcttttgtgtttcagtggtgtcagttgtaatacctcccccgtttcatttcttattgagcttatttgggttttctctcttgttttcttggttaatcttgctaatggtctatcaattttacttatcttttcaaagaaccggctttttgtttcatttatcttttgtatttttttgtttcaatttcatttagttctgctctcatcttggttatttcctttctttttctgggtttgttatttcctttcttttgctggttcttgtttctctagttccttgagatgtgaccctagagtgtcagtttgtgctctttcagtctttttgatgcaggcgtttagggctatgaacttgcctcttagcaccgcctttgctgtatcccagaggttttgacagtttgtgtcattattgtctttcagttcgaagaattttttaatttccatcttgatttcatttttgacccaatgctcattcaggagcaagttattctgtgcagaagctctttagtttaattagatcccatttgtcagttttggcttctgttgccattacttttggtgttttagatgtgaagtcctggcccatgcctatgtcctgaatagtattgtctaggttttcttctagggtttttatggttttaggtctaacatttaagtctttaatccatcttgaattagattttgtataaggtgtaaggaagggatccagtttcagctttctacatatggctagccagtttaccctgcaccatttattaaatagggaatcctttccccatttcttgtttttgtcaggtttgtcaaagatcagatggttgtagacgtgtggtattatttctgagggctctgttctgttccgttggtctacatctctgttttggtaccagtaccatgctgttttggttactgtagccttgtagtatagtttgaagtcaggtagcgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcttatccatgagcatggaatgttcttccatttgtttgtatctcttttatttctttgagcagtggtttgtagttgtccttgaagaggtccttcacatcccttgtaagttggattcctaggtattttattctctttgaagcaattgtgaatgggagttcactcatgatttggctctctgcttgtctgttattggtgtataagaatgcttgtatttttgcacattgattttgtatcctgagactttgctgaatttgcttatcagcttaaggagattttgggctgagatgatggggttttctagatatactatcacagcaaaagaaactaccatcagagtgaacaggcaacctacagaatgggagaaaatttttgcaatctactcatctgacaaagggctaatatccagaatctacaaagaactccaacaaatttacaagaaaaaaacaaccctatctaaaagtgggtgaggatatgaacagacacttctcaaaagaagacatttatgcagccaacagacacatgaaaaaatgctcaacatcactggccatcagagaaatgcaaatcaaaaccacaatgagataccatctcatgccagttagaatggcgatcattaaaaattcaggaaacaataggtgctggagaggatgtggagaaataggaacacttttacactgttggtgggactgtaaaccagttcaaccattgtggaagacagtgtggcaattcctcaaggatctagaactagaaataccatttgacccagccatcccattactgggtatatacccaaaggattataaatcatgctgctataaagacacatgcacacatatgtttactgcggcactattcacaatagcaaaggcttggaaccaaccccaatgtccaacaatgacagactggattaagaaaatgtggcacatatacaccatgcaatactatgcagccataaaaaaggatgaattcatgtcctttgtagggacatggatgaagctggaaaccatcatctcagcaaactatcgcaaggacaaaaaaacaaacaccgcatgttctcacatataggtaggaactgaacaatgagaacacttggacacaggaaggggaatatcacacaccagggcctgttgtggggtgggaggaggtgggagggatagcattaggagatatacctaatgtaaatgacgagttaatgggtgcagcacaccaacatggcacatgtatacatatgtaacaaaccagcacgttgtgcacatgtaccctagaacttaaagtataataataaaaaaaaaaaatgtaaaaaaaaaaggagcaagttatttaatttccatgtatttgcatggttttgaaggttccttttggagttgatttccagttttattgtactgtggtctaagtgcttgatacaattttaattttcttaaatttattgaggctcgttttatggcctatcgggctatcttggagaaagttccacttgctgttgaatagaatgtgtattctgtggttcttggatgaaatgttctgcatatatttgttaagtccatttgttccaaggtatagttcaaatccattgtttctttgctgactttttgtcttgatgaccttgtcttgtgctgtcagtagagtactgaagtccctcacgattactgtgttgctgtctatctcatttctttggtctgttagtaattgttttatgaattttggagctccagtgttaggtgcatatatgtttaggactgtgatattttccggttggacaaggccttttatcatttgtgatgattaataccaagtgtcaacttgattgaattgaaggatacaaagtattgatcctgagtgtgtctgtgagggtgttgccaaaggagattagcatttgagtcagtgggctgggaaaggcagacccaccctcaacctgggtgggaacactctaatcagctgctagtgcagataagactataagcaggcagaaaaatgtgaaaaggagagactggcctagcctcccagcctacatctttctcccatgctggatgcttcctgccctcaaacattggactccaagttcttcagttttggaacttggactggctctccttgctcctcagcctgcagacagcctattgtgagaccttgtaataatgtgaattaataataaactcaaatatatataatatatatatatatatatattccattagttctgtccctctagagaacctagactaacacaccattatacaaatgtcccactttgtctcttttaactgctgctgctttaaagtttgttttgtctgatataagaatagctacccctgctcccttttggtgtcaatttgcgtgaaatgcctttttccacctctttaagtttatgtgagtccttatgtgttgggtgagtctcctgaaggcagcagatggttgttgagttctgatgctcctgaagcatggagttctgagtttcctgagggcagcagtgggttggtgagttcttatctattctgtggttctgtatcttttaaggggagcatttaggctatttacattcaatgttagtattgagatgtgaggtaccattgcattcattgtgctatttgttgcctgagtactttggtttttttgtttttgctttttaacttgtatttttgttttataggtcctgtgtgatttatgctttaaagaggttctgttttgatgtgtttccaagatttgtttcaagatttagagctccttttagcagttcttgtaatggtggcttggcagtggcgaattctctcagcatttgtttgtctgaaaaagatggtatctttccttcatatatgctgcttagtttcactggatacaaaattcttggctgataattgttttgtttcaagaggctgaagatagggccctgatccgttttagcttgtagggtttctgctgagaaatctgctgttaatctgataggttttcatttataggttacctagtgcttctgtgtcacagctcttaagattctttcctttgtctaactttggataacctgatgacaatgtacctaggtgatgatctttttgtgatggatttcccaggtgttctttgtgtttcttgtacttggatatctaggtctctagcaaggctggggaaaattttctctattactcccccaaatatgttttccaagcttttagaattctcttctttctcagggacactgatcattcttagggttggtcattttgttacacccgagcgagttccatggtttgcaaacatttaaaaatgaacttatgtttctaaacattctgtagctttcttcttcctattgactcattagcaatatttgttttttcctgattataaaagtaacaaatactcaatgtagacattttataaaacatacaaaagtaaaaagatgtaaattaaaatcatccataataaaaatggcttaatactgtgaaccattgtttaaaaaaaagaaaagaaaagaaaagaaaaacaccacactttgagacaaattaagagtcctttatttaagccggcggccaagagagggattgacgctccaaaattctctcagccccaaagaaggggctcgatttaacttttatatcttggtttaggaagggggggtctagttaaaacaattttacagaagtaaagtaggcaaaagttaaaaggataaatggttacaggcaagtaaacagttctaggtgcaggggctttaagacaattacaaggtgataggcccggggcttggggcgttatcaatcagaggaattcctaggaattgtggatacagcttgccacagtatcttatcagttaattgcattcttggatgtgctgggagtcagcttgcagaagttaagtccttgaggaaggggctgccagtgaaagagccaagatagaatctgtctggttctcttagctaaggaagagtccattcagatggaaacaaggctaggtgattaaaggaaaaagggagagtctaaaaacatggttagtaaaaacgaggttgggcattacaatttaacatagtcccagacttcttggaggcttcgttcatattttttcttttttctttatctttgttggattgggttaatttgaagaccttgtcttcaagctctgaatttctttcttctacttgttgaattctattcctgagactttccagagcactttgcatttctataagtgtgtccagtgtttcctgaattttttattgttttttccttatgctgtctatttccatgaatatttctcccttcacttcttgtatcatttttggatttccttgcattgggctttgcctttctctggtgcctccctgatttgtttaataactaacctcctgaattctttttcaggtagatcagggacttcttggtttggatccattgttggtaaactagtgtgattttttgggggtgttaaagttttgtcatattaccagggttggttttctgattccttctcatttgggtaggctctgtcagagggaaggtctagggctgaaggctgttgttcagattctttttttcccatggggtgttcccttggtgtggtaatctccctctttgcctatggatgtggcttcctatgagcggaactgcagtgattgttgtctgtcttctgggtctggccacccagcaagttctatcaggctccaggctggtactcagggtggtctgcacagagtcctgtgatgtgaaccgtcaatgggtctctcagcgtggatatcagtgcctgttccggtagaggtggcagcggggtgcaatggactatgtgagggttcttagctttggtggtttaatgctctatttttgtgctggttggcctcctgacgggaggtggcactttccagaaagcattggctgtggtgggtgtggagaggaacctacggtgggcagggccctagaactcctaagagtatatgccctttgtcttcataccccacgctcatggatgggtagaatcaatattgtgaaaacgatcatacggccaaaagcaatctacaaattcaatgcaatccccatcaaaataccaccaccattcttcataggattagaaaaaacaattctaaaattcatacaaaaccaaaaaagagcccaggtagccaaagcaagactaagcaaaaagaacaaatctggagtcatcacattacctgttttcaaactatactataaagccacagtcaccaaaacagcataatactggtataaaaataggcacacagaccaatggaatagaatagagaacccagaaataagcccaaatatttacagccaactgatcttcgacaaagcaaacaaaaacataaagtggggaaaggacaccctcttcaataaatggtgttgggataactggctagccacatgtaggagaatgaaactggatcctcatctctcaacttacacaaaagtcaactcaagatggattaaagacttaaatctaagacctgaaactataaaaattatagaagataactttggagaaacccttctagatgttggcttaggcaaggatttcatgaccaggaacccaaaaacaaatgcaataaaaacaaagatagtcgggacttcaactaaagagcttttgcatggccaaaggaacagttatcagagtaaacagacaacccacagggtggcagaacatcttcacaatctatacatctgacaaagaactaatttccagaatctacaatgaactcaaacaaatcagtaagaaaaaaaaaacaaacaatcccatcaaaaagtgggctaaggacatgaatagagaattctcaaaagaagatatacaaatggccaagaaacatatgaaaaaatgctcaacatcattagtcatcaggaaaaggcaaatcaaaaccataatgcaataccatcttactcctgcaagaatggccataatcaaaaaatcaaaaaatcaaaaaatagtagatgttgccgtggatgcagtaaacagggaacacttctatgctgctggtgggaatgtaaactaatgcaatcactatggaaaacagtgtggagcttccttaaagaagtaaaatagaactaccatttgatccagcaatcccactactggttatctatgcagaggaaaagaagtgattatatgaaaaggatacttcacacgcatgtttatagcagcacagttcgcaattgcaaaactgtggaaacaatccaaatgcccatcagtcaatgagtgtacaaaggaactgtggtgcataaatatatatatatatatatatatatatatatatatatatatatatatatatgatggaatactactcagccataaaaaggaatgaattaatggcatttgcagtgacctggatgagattggagactactattctaagtgaagtaaatcaagaatggaaaaccaaacatcgtatgttctcactaatatgtgggagctaagctatgaggatgcaaaggtgtaagagtaatacaatggactgtgggtacttgaggggaaaagtaggaagggggtgagggataaaggactacaaataggatgcagttatgctgctctggtgatgggtgcaccaaaatctcacaagtcaccactaaagatcctacgcatgcaaccaaataccacctgttcgccaataacttatggaaaaataaaaaataaaaataaaaaagaaaattggaaattaaagctttaagtagagaggcgagacagtaggccagaagtcgctgtgcttaatggcagcagccctggccacctgcctgatttctagggcttatttgaggctgtgggctggggagacccgctgggctggctcaggggtctgcgtgggctggctccagtgcccagcctagaaccttcagggacttggcctacgcaaagcctggcctactagttttcatttagcgcatgtgaattcagagaaaccaggatcagaaaggttcctattaggtctgttatgattctgtccaagctcattagaatttaaatttttacctttaaacgcacgttatttttggctctgcattgcatttattattatattttatgcaaagaagcctggcctttatgaccgatcagtatttgtgatttttcacttttcatgcaattaaagcccattagaacacagccacgtggcacaggaaatgcactcatgtggctgaggaaggagaggagctgccgcattctttgtttctaattgtgctttatctgctaattgcgtttctacctgctccacaggaacggtgggaaacttacatcgaaaaatatatatctaaaggaatttagaactcctttaaaatctcaaatctgatgagaatctagggttttctttggtgcatgaacgtgtatacacaaaacatttaggaaaaagttatttaattccagaaaatagaacctttattatataaattatacaattaagtcttataacattcgttgaccttttagggaaaaaaaaaaactacctgcttttcatttctagcatcagatatttcacctttattttggtcttcatttcgtcatattccgtttgctaattcatctcttgctctgcaacagatgttcaaattatttgtgaaatagtagatctgagtcacaggcttttaatttttcatttcatgtgtgccatcgtgaagagggagagagagacaggatgagaataaatctgaggactgtgggaatctgcgatgccagttggaactcctgccaagaaggaaattgtcaagtgagagcaccaagccagaatctggagttctctttgaaagcatgtcttcctaggacacagcaaccgttcctacagccctgggaatttttacaccaccttttaatgcaaatgacactttttttttttttttgagacggagtctagctctgtcgcccaggctgcagtgcagtggcacaatcttggctcactgcaacctctgcctcctgggttcaagtgattctcctgcctcagcctcccaagtagctgggattataggtgcccaccaccacgcccagctaatttttgtatttttagtagagacagggtttcactgtgttggccaggctggtctcgaactcctgacctcatgatctgcccacctcggcctctcaaagtgctgggattacaagtgtgagccaccacgaccgacactttcaaggacagcttagcttgctgagttagtaacgttcacacaagcctcctcttgaacaggaaaataagactggcactcctgaggcactcttatcacacgagagacatggaataagttagagattcctcctccctgtcttgccttcgtctccttctgaggctcttctgttaataatgtagacttgcacttttaggcccgactcagaaatttcattaattagcacggtcatcaaagtagagctccactttgctgacagaaagggagaaagggctaaagagaatcgtgctgggtaacaggaaaataaggaacactgcacgattttccaccacagagacccaagcaagaatgttcgcagcagcagtgcttggaataacaaaagattggaaagaatcgacatgaggttctgtcaagttaacttgggaaaacagtgtttcaaaaacattaaattaggagctctcctgcatgacttctccaacttgtaacatttcagtgtgtgttgttgtcagaggtgtttgaaccagagtaactccatcttggataggggctgggtaaaataaggctgagacctactgggctgcattcccagatggttaggcattctaatgaggtaggaggtcagcacaagatacaggtcataaagaccttgctgataaaacagtttgcagtaaagaagctggccaaatcccatcaaaaccaagatggtgacaagagtgatctctgggtcatcctcactgctacactcccatcagcgccatgagtttacaaatcccatgacaatgtcaggaagttaccctatatggtcaaaaagaaaaggcatgaataatcctccccttgtttagcatatcatcacgaaattaccatgaaaatgggcaaccagcatcccttagggctgctctgcctatggagagccattctttattcctttacttaataaactttcactttactctatgggctcgcctctaattctttcttgcgcaagatccaatagccctctcttggggtctggattgggaccccttttcggtaacactgtcaccctccaagaagagaggctgagcatgctgagtggaccacgttttcctcctcctcttccttcttacatttaaaataacacccatttgcatctcccgtcactcatgctcaggagaatgtgctgtgagaagtgcagaatgagatgttcaggagaggttcaggggcctgcttcagtctccagacattccagcttccgagggggccctgcagggccaccagctccctcacgctcaccccactaggaattactctatttacagacaaaaatgcctgccagttggtatttgtcctttcctagaacataccataaatacaaagcaataaagaataacgtttttatgagtttaagtttttgtctggtctctaatccagcagaatagcatgtgatacaatctcatgactttcagagctatacaggagaaaactgctcatagcagtgtcgtgtgtttccaggcaaaactgaaaacatgaatacagcactggacacctggtcagtccttaacaaattactctccgttgctcaacttcaatgacaagaacaaatcaaacaaagaagctgggcagggctgctgctgactggtcacctgacggccaatggacagtgacttttaaagtttactttcttttattcttgggggagatcatatagtatttgagggtatagttggggaacaccacattaaaaaatcgcaattcttagcttctcttgaaaagtttcgagttccaggttcactaggccgtgggtggcagccgctccctccagacaagtcctcctggttctgggctggagagagtttgtctggcttggctcccggcagcctctgggattctgtttcttcctctctgcaaagaaaggtgcccagctccaatggctctctatcttccatgtggggacacctcttctgctgtcatatctgcacctgtgagcctgttccttcgtagacatgctagcggggagtccagtggacacagacacacatacatgggttgactcagctacgtgtaactggatatcagtttagccactaataccccctaaaaatgagctataaatccgagaaacagttcggatggtcttttttcccactggagaccacacttcttgcagacactaaagccctgctaaacacaatgcgggcccagtagaactcctgtagtggcgctcctggccagggtgggggtggagggaatggaaaggtagccagagaggctggttctggagcccctgcgcctgcagccctttccccagtccctgcaacaggaaggcctcatccttctacactgcaggtatcccagcagacgaaaagcaggcactctctggagagggctcagctgacagaggactgacagacgtcccagtgcacatgaagtaaagtctgaagcttgcccgcccccagctcgcgcccagctctgcctgtgaacacagatagctccacctctgtactcagaagtgtgtccagaattgatgggttcttggtcgcactgacttccagaacgaagccgtggaccctcacactgagtgttacagttcttaaagacaccgtgtccagactttgttccttctggtgttcggatgcgttcacagtttcttccttctggtgggttcgtggtctcgctggctcagcagtgaagctacagaccttcgtggtgagtgttacagctctcaaatcggcgcgtctggagttgttcgttcctcccggtgggttcgtggtctcactggcttcaggagtgaagctgcagaccttcgcagtgagtgttacaggtgataaaggcagtttggacccaaagagtgagcagcagcaacttattgcaaacattgaaagaacaaagcttccacacttgtggaagggaactgcgccgggttgccactgctggctcgggcagcccgcttttagtcttatttggccccacccacatcctgctgattggtccattttacagagagccgattggtctgttttacagagagctgattggtccgctttgacaggatgctgattggtgcatttacaatccctgagctagacacaaaagttctccacctcctcactagattagctagatacagagtgtccactggtgtatttacaaaccctgagctagacacagggtgttgattggtgtatttacaatcccttagctagacataaaggttctccaagtccccaccagactcaggagcccagctggcttcacccagtggatccggcaccgggccgcaggtggagctgcctgccagtcccctgctgggcacccacactccttagcccttgggtggtccatgggactgggcaccgtggagcagggggcggtgcacactggggaggctcccgcagcacaggagcccacggaagttggggaggctcaggcatggcgggctgcaggtccggagccctgccccgcgggaaggcagctaaggcctggtgagaaactgagcacagcagctactggcccacatgctaagcccctcactgcccgggccggcgggctggccggccgctctgagtgcggggccgctgagcccatgcccacccagaactcacgctggcccgcaagcaccaggcacagccccggttcctgctcacgcctctccctccacacctccctgcaagctaagggaacaggctccagccttggccagcccagaaaggggctcccacagtgcagcagcgggctgaagggctcctcaagcacagccagagtgggcaccaaggccgaggaggcgcccagagccagagagggctgtgagggctgccagcatgctgtcacctctcagaagcaggagaagtcccgcccaagagaaaacaaaaactatacacactgactttcggggatctcccaagaaatgctagatgattagatgatccacccgagtccatatagctgtgacagatgatgaaccttgaagatcttgttgcattttggtggggaactgtgggaatcgggcagggaatcactttcacccgcagcttaccaggacctatctacagggatgacaaaagcatcccctaacaggtggctggagacctgaggctcaccaagtgccccagtcatgaaatcacagaaaaaaactaccagaggccagtgcattgctctccctgcctggcaggtgcaaagtcagtggagagaagtagtatcacggtcgagcatgcggtgagaacaacgcccacggaaccgggggacacatggcaagggctgaagctgcaagttctgagcacgtcagcccctgcgcctcacccccaccttcctgttctccaaactgaaatgagcctccgggccttgtccccaaccacttccctgcatcctttaggcctcggcttgcaggccaggtgctcagagaggtattggccacgtccaccacacctccccacgtctttcctcggaggacttcctgttgtctgaaactgtccaccgcagctccccgtgtctttccttggagcacttcctgttgtctgacactgtccaccacagccccccacgtctttctttggagcccgagctgctcaccagaagggagcggagccaggatttggcttgtctccaggacttgtcttgacactgccgtgttcctagcactcagaacatgccggacacggggcgctccctctgtaaaatgtattaatccactgaatcaaagaatgactgaatgtacaccatggacagatagatatttctatggaaccactgttaccttaaaacataccaatttttattttgctgggaatgtttactttgctaggaaagtttactttgctaggaaactttgggggtttggaatcaactttcaaattgcagcttttgcatggaatctctttatctataataatagcaaattcacatgaagaagaatgaaaacagaatgatgttcctacaaacggaaaaattctgggccatcatgacaacgcacaaatagctgtcaaatgctaaatttctcatgaagccaagagaggccaaaactatccctgacctgtgattagtacaataaaggctgtgcctttgggcaacaatgggaacagagatgaagacttcaagccagacagtccagcagccccagcctaaggctatgttctcctgtaatttattactcaggatgaggaagctaaatcagggttgccctggttactatggggctcttccgaggaccctggcgacataattggtgttggcttggagactgaggctttcaattctgagattagagtgctggtaatagaggtggctaccccctcaagaagaaattcaaacaggctttggaaaaaatgagatagtctcaaaattaaggtcctcctccaaaatgtgccactgactgtcttaacctgtggtcctgacagattcagcaacaatacataattggctcattcaaataataattgccttttaaaaatagtaacaaacagaatcatgaaacgcttaaccagatgatgtcagctaactgaactaggttgtcacacacagagagagcagcgtctgctgtgaatatcctgctcagatcacccttcggcagacatttcccgagttactgccacagccccgtgctggacactcagaggaggaagaactctggggatagcggcttggaggactggctggagggggaatgacatgggatgtggcccaagaaacagattttccaaagagaaagggacagtaatacagagaacaggcaggaagagggagataggactggaatatagttcattaaaatggaattcagccaggggcccttctcaggcacccagaaccctcatggctctgccaccaggctgagaatagcaaacaaaggtgatcgggtcccagaaatctgaaacacgtttttgagcatctggggatctgtgccctgtgtttgcaggctggtcttaaaggcgcctggagtttacagggggcggtgagcaaggcaggaaaagcggaggagcggcctgcatatttagggtgcaagggtctgcgatgtcaccctcacacctacacccacagtccataagggtcatcaggctcatcagctgggtggtcgctgcaggccagaaagggctgggaggacaaagcacagaacagggatgcccacccctcctgctgtcatgaggctaaatctgcttcccccacacccagccgccaccagggagagaaggagaagacggaaggaaagaggataggaggggctgaataccttctggaaagagacaaagttaatcctggggagactgttttaaactggtaaagggggaaccactctgcagtggtaagagttgaattcaatttttctaaatcagtggccacagaagtaactcacttctacatgccaagtagaaatcagttacagaaaatgaagaacacatttctgcagttctgagccaagatatgagaattttaatcacaccacatataacagaagtcaacaggattgagactaaacatctctcataaacataagtagacaaaacttgccgatgagaaaaaaaaaagaaacttgaaaacatgatgctaagtgaaagatgccagacacaaaaggacaaacactgtgccgggcatggtggctcacacctgtaatcccaacactttgggaggctgaggcgggtggatcagtttgagaccagcctggccaacattgtgaaaccccgtctctactaaaaatacaaaaattagctgggcatggtggcgggcgcctgtaatcccagctactcaggaggctgaggcaggagaatcgcttgaactagagaggtggaggttgcagtgagccaagatcacgccactgcactctagcctgggcaacacagcaagactccgtctcaaacaaaaacaaaaacaaaaacaaaacaaaacaaaatactgtatgcttccacttacatgagtgacctagaatgggataaattcatagagacagaaagtagaatattggttatcaggggctggggaagcagagaaatgaaaagttattgtttgatgggtataaagtttctattagggatgatgaaaaagttctggaaatggatgttggtcatggtttcacacaatgtgaatgtacttaatgccactgaattgcacacttaacatggttaatttagtaaactttatactgtgtatattttaccataaccaaaaagaaaaaggactctcactttcataagtagaataatatactgtttaattattaatttagaagcccaatcaaaaaaggaaaaaaagtcaaaaggtacaaattatcagtgagataacagaccttgcacacagaggaacttaacatattagaaatgtacaaaaatattgtaaaatatttactaaataatactatgaactattttatgctcatgacttaaatgatgattcaaagcccaaatagatcacaaatgtaaaaaaatgcaaaaattgccaaataactatatccttagctatcatcagtctgacagtttaattggtgaatcttttcttttcttttttaaattaaaaaatttttattaggaacatttttgtccttggtaatacttccgaataaagaaatctatgaaaatgctatggaaaattaaattaaacaacatataaaatcacctgggcacctggaagatggtgaagaaatattttgtgacataaatataaaactgaactatcaatttttaaaaagctttagtgtttcgttaaaagtatgaaaaagaaatttaaaatatgcttaaataatcattagagatatattcagaaaggaaacttattaaatgtactacttttttcattctccatggtaaaactgagaatgagaatcttggtaaaggttaaaattttgaaataatagcgtatctggggacatcaactattccttacatcttgaacacacaatctttctatttacactgtaaacatgctcagttttgaacctaccaccccctatacctgacattatctttgctctatctttcaattcttaattgagcttatggaaagagacataccaatgtctctacctttttttccccaaacctttctcctcaaaccactactatctggtttctgcttccactacatcatatctgaaactaaaatgtcaaagcaatcacgttgccaaatgtgaaaaaggatttcccagaccttttgggagttggtatcattgcttcacatggcattactaacctgtcccttcttgtacttgttttctcctggctttggatatggcattctttctgccctgcatacttctctatcattcctgtttggtctcattagctagatccttttctctacttgctcctgtagtgcagactctgctcttctcattttatcctctttttctagacaatctcatccactcccatggtttcagttgctatctataaactatctttatctctatctcagaccactttggtgacttccagcatcatacagccatccaaccatctgtgagatttctccatgtggatatccaaagacacttcaaacttaacattaaaaaaaaaatctcacataccttcttctcccctcaaatcagctgttcctcctaaaatctctaccttggctgatggttcattatcaccctgtcaagacacctggatatcatactctcattcatttctaacttagtctcaaagtcccatgaattcaacctttcaactatttttaaaatctgtccattcccacttctcaccactattgccttaggttggatccttcataatctcttaggtggactatagcaatggcctcttagatgttcttggcgtttccaatcttatttcttccaatcaatcatttataatgttgccaaaatgatctttccaatacgtaaatctgatcacatttctcccaagctgaagtaatccctacagctcttaaataattagttgcttaaagaattcatttactcactcatttaacaaatattatttaccacataacgtatgattttaggcagagaggaaattatagtaaatgaaaatatttagagaatatgcagaaaggtagatattaaacaatcccctaaataaatgtatgattacaaatttgacaaatgcaatgaagaaaaataataagtcacaaaggaagaaaaagaggagacctactagagattgtgaagttatattatttttgagagaataatatctcggtaagtttaaaaaatgagtagaagtcgctcaacaaagaagtagttttggtagagggaacagcacgtacaagggatctgaaagggaaaggagattagagtgttaaaagaaatgaaggtaagcctatttggcaagagcttagtgaaggatgggatagtggcctgagacaagattattgacatagaaaccaagtcatgtagggtttgtaagccaaggtatggatttgggttcttttgaaaggctatgggaagcaattaaaaagttttaggcagatgaatcacatggttatatttacatcttaaagtttcactctggctgctggtagagaatagattatagcctgagtggatgtgagaagactagtaaagggattattccattagtctaggagagaaaaatggtggtgggcagtctctattaacttttagaagttatctttaggtaatgtgagcctgcaacgtgaagttcctagtactttaaaagttataatgctgatgaacaaaaaggtatgtaaaaactcaggatttaatctaattagatacattttccaccattagaacatttctgctcagagatcttattacaaagctacatttctgatagtctactacgatgcagcttctgccaaagccactcagtactaacctcttacacagcatctctacttacatgattaaaatgcatatcatacttgacatagtcaaaagataaagaaccacttgatttctacttccaagctactcaactccctagtaaatggccttaccatttaccctacccaggcactgatgtaaaaaatctgagagttaatcataatttttctcttcctctcatatcccatatcatatgtaaattaagtatcaacttaaattgaatataatattcaatgtaatgctatgaaaattattgtatgtgattaatgagaatataaatctggctataaaatctctgatagtgatatagtatttatatccatatatccttaggaaaaaattccctttaattatagagtagttataaacagtagtctaatatagtatgctatagttgtgttttgccttaattattcttcattgttaatacctctataataaacatataaaataaaacgcttaatttcttagtttgcaaattaatttaccaattcgttcattctttctttgtcaagaatggaaaaccttatagcaatacaggtcatctcaggtccataaagagtaatttaagatcagaaattcatgtcaggtccatgaggaataagttttcttttcttttctttcttttttttttttttgagacggagtctcactctgctgcccaggccggagtgagtggcgcaatcttggctcacagtaacctccgcctcccaggttcaagcgattctcccgcttcagcctcctgagtagctgggattacaggcgtgggccaccacgtctggctaatttttgtgtttactagtagagatggggtttcgccatgttgtccaggctggtctcgaacccctgacctcaggtgatctgcctgcctcagtctccaaaagtgctgggattacaggtgtgagccaccgctcctggccccataaggaataatttaagatcagaagtacaaagaaagttttctaattgattttaaaattagtttctgaatatttctctaagactatagtttaaattcgatctatttcacaccaaataagtactacagcaatatttaatttctgcgttactattgacatatgagtcatctaacatgtaaactttcagccaaccaaatattatggctttagtgctaatttaaaaaaaagtttttgaaaggaacatttgtaaaatatataaaggcattcatctgccttctttttttttttaaagagatggggggtctcattttttttaaagagatggggggtctcactctgtcacccacactggagtgcagtggtacaatcatagctcactggagccttgaactcctgggctcaagcaatcctcctgcctcagccttcttagtagctgggactacaggtatgcaccaccacacccgcctaattaaattgtttgtttgtttgtttgtttgtttaagagacagggtctcgctatattgaccaggctggtctcaaacttctgggctcaagcgatcctcctgccccagcttcccaagtagctgggattacaggcggtgtgccaccacgtccagctatctgcttttttaaatagaggaagtgaatatcatgttaagttattcttaaagacttaactaagattacttatcatactttgtcacaatatatttaaaatacttcattaaattctgaggtgagatagtaaaccatttgtgctaaccctaaatagcctttttagtttttgaatagtcttcctatctccaaccttttcagatgtcccttcatgtcagaatgtcttcctctgctaatccttctctgtgctgtatttgatctgctagtaataaagcttgataaacaagtaatctgtttatttcatcaggctctattcaaggcttggagattgactctataactttcccacattgaaaagtgcaagtggaagtgggagcttctgattgatagcttttgagcttacctccgggtttgtaactgtattctttagttaaagctatcaggaatttggctaccagataagtgagacataaaaccaagtatcattactaaagcaatctagtgatacagaatattactgtgtttaaataacttatcctacataaacaacaaggtagtgttaacctcacactcacaattctgcatgattttatgacagatatctaggatttaaaaaatggatatagcttatatccattataattttgttatactgagagagttcaaagttggcatcaagggtcaaaggtagaaattagcttacatagaaaataatttgtataggccaaacagaccttttgtatacaataccacctactgtaatttagtccacaaaatactgactataagaccataatcaaaatgaaatgctatgaaaggtgtgcgagagcttagtttatgcactgtaataaagctatggatggatgggcatagcgcatctcctgttgcacgcactctgttgctcatcaagttacatggatctgagctgtttgttaaccacagaagaaggtgaatcagtctgatgatgtgtgtggtgtccagatgcctcaacagactgcctttgttcactgtctggcgaagattaaaaaggagtagaatgagggctttctgtgggagatgatgtcaaatgagcctgagctgacattgtagaggatgtagatggctgaagaaactgttcagctggagtatctacttccattgcagtttcactcacttccaaatcaggacttgatgggaccataggaagagttgaaatatctgattgacttgttccacctctgggtcaagatcttcctcatcctctattgctttgtgcaacctcacttgcttcttcgaaccgtcttgataacatatcagacattctctgcatcaatgacacattgggactctgctctccatgtcattctcgttcactctcaggccttgatctgggtccagtatctgaccaatcaccacgaaggctcaaacgcttaactggtggttgtcgtaactcttctcttctctcttccgcagaaggagttttaagttctcgtgctgtatcatctttcgggtcaaaaagatatatgtaatctgaagagtaactaatgagaatctcttgaccatcttcactgtaacacagaaatgtcactctgcaggacttattattaagatgggaagcaataaaatgggcaaccattccagtagtccctcgacctgcataattccctgtagctcttgtgcccagcattcgcctatcatatatttgtactgagctataagaacaaccaacggcaaggtaatatggtattggtgggcaaatagcaacagatgtggcagcacgtcgacagctaattaaaatatcatcttcacaatcttcttttgtgcagctagttttgatgcgtgtatcaaaccacctaccagttctatcttcaccacaagagagaaaagtgtaagggtcattgggtacagtcataatctcataagtagttccattgtggcaagtaaattggcattgtctgttggtttctgcatcttgctcaacattggtataaaatattactccatctccagagcaggatacaatctgtttatcatttgtgcaaggtaagaactttgcattagatatgtttgcttggtgccccgaacgaattgttgtcaaaacctttctgctgtagggattactaattactaatttggtgtcatctgagccagataaaatatattctccagtgtcattccaacagattgtattaacacagccatcatgcacatttagggttgcttgaagtttcaatctttagataaattctcttcttcccaggtagtggccccacagccaggacaggtcctccagcccgagggaccttttcctcatgtcccacaacagatgtgggcaggagccaccccgagacatggctctgcctgagcgaggtgggaggggagaccctacctgaatcttttcaaagtgtcataaaacagatagttctatagtcttgatatcattatagaacatttaaaaaaataaggaaagcttctgttttccaaaagcacttaataatgattggtcctgtttacaggttgtgatattttgtatactccttcttttacctttttttgctgtaagatatctgcgtggttgccttctattgtcttttcatcttgcttgtccttaacatgaaagtcctggccacaccttagcttttctttgctaccttaaagagagtctctaaacatgtgaaaattaaacaccacagttctaaataattcatggatcaaagagaaagcctcaaagaaaaaatcaagagaactgaatggacacaaaacatatcaaaatatgtggagtgcagctaaagcaatactgagagggaaatttatagcactagatgcttacataagaaacaaggaaagctcttaaaacagtaagctaattcctacctcaggaaactagataaagaagagcggctgggcgtgttagctcacgcctgtaaacccagcactttgggaggccaaggtgggtggatcacgaggtcaggaattcaagaccagcatggccaagatggtgaaaccctgtctctaccaaaaatacaaacattagctgggcatggtggcgggtgcctgtaataccagctacttgggaggctgaggcaaaaaactgcttgaacccgtgaggcagaggttgcagtgagccgagattgagccactgcactccagcctgggcgacagagtgagactccatctcaaaaaaaacaaaacaaaacaaaaaaaaacccaaagcaaacagaagaaaagaaatcataaagacaaaagtacaaatcaatgaaataaaaaacagaaaaacaattgatatgaaaacttttaacaggagttggtactttaataagatcaacaacactgacagaagtttagcaagaaaaatgctagaaaacaaaaattatcaatatctggaatgaaacaaaaatataactacagaccctgcagacatccaaaggataataaaggagtaatatgaacaactcttcacaagtaaatttcacaacttagataaaatgcatcaattccttgaaaaacacaaactaccataattcacataatatgaaacagataatttgaatagccctgtaaccattaaggaaattgggaagccaggcacaatggctcattcctgtaatcctagcacttttggaggctgagatgggaggatcgctggattccaggagttcaagaccagcctgggcaacatagtgagacttctctctataaaacataaaaaaaaaaagtagccaggcattatggcatgcacctgtagtcctacctactcaggaggctgaggcaggaggattgcttgagctcaggagttcaaggttgcattgagctatgattgtgccactgcactctactctgggtgacagagcaagatcctgtctcaaaaatttaaaataaaaaaagagaaattgaattcatagcattaaaattctccaaaataaaacctccaggcctagatagtttcactggagaattctaccaaatgcctaaagaataattaacatcaattctacataatcccttccagaaactagaagtgaagacttcacaacacattttctgaagctagtattactctgatactgaaaccagacaaagatagttgaaataaaaaaaagaaggaaggaaggaaggaaagaagggaggaaaaaagaaaagaaaaacaaccataaaccaatacctctcgtgaacttagagcaaaaaatccacaataaaatatgtacaaaccaaatccaacaatgtgtaaagattactacatgccatggccaagtgatatttgttttaggtatataaaactgattaacatttgaaaatcaatgaaatccaccagatcaacaagccaaagaagaaaaattacatgattatattaattgacaaggaagaagcttttgacaaaatgaaatgtgttttgcccattttctaattggcttgtttttcactgttgaattttgaaagttcttcatatattttagatactagtcctttggcatacatgtggctcactaatattttctccctgtctgtagcttgtcttttcaacctcttcaggtggattttcggagacctggtttttaatttttcttaacattttccttttataggtgatgattttggagtcaagtctcagaattctttgcctagcactagataccaacattttttctcctatgttttttctaaaagttttgtagttttgcattttatatttaatcccattaggttggtttttataaaagggatgaggtttaggttgaggttcactgttttgcctatgattgatgagcacatgaaaagatgcttggaatcattagtaatcagggaaatgcaattcaaaaccatcatgagatactactttgtacccactaggatggcttaaaacaaagtcagaaaagaaacgttggcaaggatgtagagaaactggaaccctcacgcgttgctgctggaaatgtacaatggtgcagctgctccgtaaaatggtctggcactttcttaaatgattcaactagagttaccaagtaacctggcaattctattccgaggtattaggttgacgcaaaagcaattgtggtttttgccattaaaagtgatatacccaagagaaatgaaaatatatgcacataaaaacttgtatataaatgtttatagcagcactgttcataatagccaaaaggtggaaacaacccaaatgtccactgatggatgagcggataaacaaaatgtgcttaatccacactatggaatattattcagacataaaaaagaatgaagtactgatacatgctgcaatatgtatgaaccttgaaaacattatgctaagaaagaagccagtcataaaagactacatattatgtgattccattcatatgaaagtccagaacagggaaatttataaagacagaaagtagactagtggtagcccagggatgggggcaaggaaggagagtgagagctaaaggtacagggttgctttttaaggtgaaattgacttcaatgatgtttacatacatctgtggatatattagaaaccactgaatattataccttaaatgggtgaattatatgatacatgagtgtattagtctggagctaggcgcggtagctcacgcctgtaatcccagcactttgggaggccgaggtgggcagatcacaaggtcagaagattgagaccatcctggctaacacagtgaaatcccatctctactaaaaaaaaatacaaaaaattattcagcttggtgggacgtgcctgtagtcccagctactcgggaggctgaggcaggagaatcgcttgaacctggaaggcggaggttgcaatgagccaagatcatgccactgcagtccagcctgggtgacagagtgagactccatctcagaaaaaaaaaaagaggtttaattggctcacagttccacaggctatacaagaagcatggcagcatctgctgccggggaggcctcagggagcttccaatcatggcagaaggtgaagggaagcaggcacgtcttacatggccagagcaggagccagacagagaggagcgaggtgctacacacttttaaacaactagatctcatgagaattcactatcatgatgacagctccaagaagcatggtgttaaaccatgagaaaccaccccatgatccaatcacctcccaccaggccccatctccaacactggggattacaattgaatatgagattcgggtggggacatatatccaaaccacatcaatgacttacatgtcaataaagagatataaaattgttttgttttttgaaaaaaatctaatattttaataagccactctctcaagccaatacaaggcagctccagcacacccctgcttcaggagatgtttatgccacatgaagggaggaaaccataatcctttccacatccctcaggtagacgtggaaataaggataaggtgaaaattacaaaaaccaagctcatcatgcctccttcccttgccaccaaatgcttgtatttctttttaacacctgttccccgggttgtataaaaagtcctttgctaattacttttaggaaaagggcgacattctggccttcacctcccagaaaccacgcatcatacttgaggcacacaccagggaagaggctgaggtcaagttcaccaatcagaaacacaaacagacaaggaaaaagaaggcagcaatcagtttccatcaaagccctcagccaggtgtcagatctcccagggacacccctctttaatttgggggggacataggtaaatatgtgtatccagaaagcctggagcaagtcgagagaggcatttgattagtatgcagatcacaggcacagctgggatcagggctaaccagactttcaaggataaacagctgacaaggatatgtcatgttgtccctgcagtgtgttgaatctaattaaaaaggacttagggtcagaaaaacactggtgtaataatgggtaagcacaacagaaatcattttattgtttacttacaggaaacaatacttttcccgtttacatgcttgacgtggccagcaaggaagagctcacacttcgtacaaaactacacactagttttgcatctctttgttgtgacacacaacctctggtttagattctttaaaattatctgtatgggacagtttctctcattattcaaagaatgacttttccccaaaataaataagatatattccttccctccgctgtcgggtgtttctcatgctctcctcttttaattgtcagtataattctagagtaaaagtcctatgtgctatggtttgaataagctccccaaaaagcatgtgttgaaaacttaatgtttggctggacatggtggctcacgcctgtaatcccaacactttgggaggccgaggcgggcggatcacctgaggtcgggagttcgagaccagcctgaccaacatgtagaaaccctgtctctactaaaaatacaaaaaattagctgggcgtggaggcacatgcctgtaatcccagatactcaggaggccgaggcaggagaatcgcttgaacccgggaggcggaggttgcagtgagcagagattgcaccattcactccagcctgagcgacagagcgagactccgtctcagaaaaaaaaaaaaaaagaaagaaagaaaaggaaaacttaatcctcaatgcaacagcgttgggaggcgggggcctatgggaggtgctttggtcagcagggctccaccatcaggaatggattaatgctgattataaaagggcttgaggctgtgagttcaatatcttgctctttctttggccctctcttgccctttcaccttctgccatgggatattgcagcaaaaaggcccaggctagatgctggcccctcaatcttggacttcccagcctcccaaaatgtgagaaataaattacccagtctgtggtattctgctatagcagcacacaacagactaagatgcactgtcaagccaaaatataatgatttgtgaacggctaacagcacaggttggaatctgatgccagctaactcccaaggtctcagattccctacctgtctcccatgcatagttgtcagaagtaaatgaatgaacgtacagaatgtgctcaagcagtgccctgcacacagcaagggctcaggaaagttagcgaccatcatatcatcatcatcatcatgatcatcatgcagtcagtattaggtttgtataaaaatatcaaagagcacattttaagcttatgtccaaacatatactaaaatgtgttaaatacgtatcttttatgtaattttccacctaaatttctagtttctgtgacaatgctaagtaggaaaaatattttaattcattcaatgctatcataatgaagattttgtttgttttctttataatgaaattagtgcctgactatatctaaatttacagaagaaaaagaacgtatattcactgaggtcaggcctgcgatagcaaaacagaggggatgggctaaccgcttctcagcaggggtaaagtactctctgctgcctttcaaagatgaagcagccccctagatatacagcaatgtatgaaatggaactttgagtagggaaaacattgcagacaaatgcatacagtataagcatatttgcttaaaaataaaactatacagttggatgactgtgtacatatacatgtacataaatatatatgtgcatacacaaaaatggatacatcataaagcaattgcctgtgtggtagggagtaggaggcagagagaggagggagactttgttttgctccagtttgtgtacttcttgcatcttttacaatgagaatctattactatttcatttcatatttaaaaagaaagggaaaatagttctattcatttaaaaccaaatattcatcaagccatataatgcattatattacattaaattgcatttcaaaagcatcctctgttatgctttcatttaaaaatacagtaagaaaagtatgatgggaaatcccaaacttctgcagaatgaattgaaataactgagtcattaaaaatcagtttatttcccagtgctttgggaggctaaggccggaggatcagttgaggccaggagttcaagactagcctatgcaatacagtgagacccccccccaccaccacccttacaaaaaattaaaaaattagctgggtgtggtggtgcatacctgtagtgccagctgcctggaagagtgaggtgggaggatcacttgagcccaggagtatgaagctacagtgagctatgattgcaccactgcactccagcctgggcaataggtgagaccctggaccctgtctctaaaaaattgttttatttgtatttttatgatttatttatttgaagacatgttctcactttgacacccaggctggagtgcagtggcacgatcttggctcactgcaacctccactgcaccccctgcgtccccctgcccccggttcaagtagctgggattacaggtgcatgccaccattcacacttaatttttgtattttttggtagagatgggatttcaccaggttgtccaggctggtctcgaactcttgacctcaagtaatctgtctgccttggcctcccaaagtgctgggattacaggcgtgagccactgcacctggccaaaagaattttttaaattaaaaaacgtgtatattttttaaaaatccattttttaaataaagttttgttgctgtcatattttaatgtgcatggagcctcaaattaaaacataatgaggcattttaaggggcatttgaaaatcaataatgctcttttctaattaatttaagtgaaacagcatgtttgcttgaaatcccaaaatgcctttttaatttcctaaggggctcttcagacaggaacagttgggaggcactcagtggttcactcacatgctcccctccaggaatggtgccaggccctggatgtgggacaaggcgcagcacagacatggccttctcccttgtgctgctttgccatgtagcgaatgatggggaaatgtcagggcttggagaaaaagagacagaatgctcagagaaccgcagagctggggagccccttggacgagggctgagggaaggcccttgcatcgatgtcccaccgactctggaatctagaggtccagaaggagccacctagagaccagctgggaggaagaacagctgtggtgcagcgtgcaggggcagcctgaagtagaaagaccctgagattctagcacagctggcaaggcagggacgtggtgcccaggagtaccactgcaggctagcgaagctggaggagccagatgaaagcaggcactcacacgccacggcgaggatgctggacagcgctccgagtccagtgggaagcacgtggctgagtttatgttgtaagaagctctctcgccatgaacacacacacacagacacacaaatatgtgaatacattttgatcacaacaagctgggaatccatgttttgttgtatttaacaaaaacccacaaaatacatccaaaaactattcctatacaaagttacagaaaattttagtggattgtaaaaagtagaaattaggggccacatgttctcatgcaatgacgttagaaattaacagtaaaaggaaagcaaaaaaccaaaaagtctaactacctaaaaagttaaggacatcaatctgagcgatgattaggttaaagagaaaagcaaaaatgaaaattacaaaccaagtggaactaagtccacaagagcactgtgtatcaacaatgccaatctatacagtattattactgttactcaactataaaagggggaaaattaacaatatgtgaattaagaaagtagaaggggttaataaaataaaaacatacatagtcaacccttccctcaaattccccatttcctcccgagacccccggctctagggaactattaatctactttgaatctctaaagatttgctaaaatgtttatttttgaactgtaaaagaatattatctgtagctttataacaataaattggaaaaaacagatgaaatatacaatgttcgaaagacattaacaaaaatgatccccaaaaagaaagaaaacacgaataacataatgaacatgggaaaatacgttaaaagtagtcaaattacctcccccaaattaaaataaacctagataattcccaggttatataaactgtttcagagcataagtcaaatcaaattcttccactttcattttaaagtatgcataattctaagatgaaactggacaaggagggcacctcaaggtaaactgtaggttatctcatttctgaatgttgatgcaaaactcttaaataatatattaacaaagtgaatgcagcctaatgtataccttctcagcaccaggaccattgcctatttctgcaatgcaaaagtgattctgcattaggaaatccattaatgcaaatcactacattaataaactaaaggaggaaagccatatgatcatcttcagagatgttaaaaggatggtgataaaatttacatgcatcttgattaaaaaaaatcttagaaagccaggatggaagcgaatacctcccattaataaaggcatctctcagaagctgatggcagacattactctacatggtaacccattaggagcaatcctgtgaaagccaggaataaaacaagggtgttaaaaaattccagtgttagtcaacctttttccctgtaaatcctcactgtgagtgaagggtcacatcgggtctgggctgacgcatgtgcgccaggaaaaatgacccaaaagttctgtcctctcaggtcactgcttccttttctcggacactgcagcgttgagatggatatggaaggctgtggtcatctcatgtgctgggaaggacgcctggatcagggaagcagcgtggtggcctgcaggccttgggcctccgtgaagacaaaagtgttataaaaacaactgatggaaaagtgaactgtggcttctcagtgagagtctcccccacgcaggcagtgaacaccgcatgtgggtgagagggaaatggagctgcgggacctcccagtgatgtgaagatgctgtccctgctgtgtctcctgtcctgtgtcctatgaagctcagcaaatggggagatttgctaatagaaaccatctctcagcagcatgcttggtggtgggtcactaagagcttctcattaaattcaggagcaagaggtggatgatgaaataccatcatctaatgttattttaacaaaacatcattatccaatgttatttgaacagttttagccacagcaactacacagaaaagcaaaacaagatgtacagatactggaaagcagaagaaaatgtaatcatttcctctgacaaactatgggatcaaagattcaggtgtacattcaactgcttgtacagttcaatgcaagtaataaaaaactgcaaaaagtcttacatgcggcgagtagcctcttcagtataaaataataactaaaacaggcatccaccagagcaagaaaatatttacaatacctaggactaaatttgaaacatggaaagttcatatgtatattttagaaaactataaaagtgtagtaacatttataacaaaataaatcctagatcgataaaacacataaatatttaaaaaataaaacccgaaaatactgaggggatagtagaaaattatttataatcttggagtgggaaaggcttttctaggaaaaacacataacccagcaatcaaaagggttaaaatacgtaaatgaataaaaccaatgtgagtacagaaaatacccacacaaagaatgccattcaaaaagtcaaaagatgcataacaaactattaaaaatatatgtttgcaaccaatataacaatagccagtttccttaacataaggaagtatatatatgtatataatatatataatatgtaaattataaaaacaacaatataacagtaaaataggtaacaaacgtgaagtggcagttaacagataaagaaatataagcaacttataaacaaatataaagatgctcaacttcacttttaattaaagaaatgaaaattacataataaaattgtacaattttgtcagattggtgaagacaaaaacaattctgacaacacacaagtttggatctgggtaaccaggcacaggctcagactgctggcaaaggtgtgaaggggtgccttgtgtttggagagcaatttaggaataagattctaaatttaaagtgcactcatgctctgactgcagggacggtcttagtgatttttttctctagatctgtttgcattccttccttgttcactgctacacccccagcacctaggccagttccccaagcagcagcaatagccactcagtatctgttgagtaatgaatatgtacaaagaatactattcaatcgggcacagtggcttacgcctgtaaacccagcactttgggaggccaaggcaggtagatagtttgagttcaggagtttgagaccagcctggccaacacggtgaaactctctacaaaaaatacaaaaaaagttagctggttgtggtggcacatgcctgtagtcccagctaattgggaggctgtgacgggaggatcacctgagcccagggaggttgaggctgcagtgagccgtgatggcaccactgcactccagcctaagcaacagagtgaaaccctgtttccaaaaaaaaaaaaaaaaaaaaggctgggcgcagtggctcatgcctgtaataccagcactctgggaggctgaggcaggtggatcgcctgaggtcaggagtttgagaccagcctggccaacatagtgaaactccatctctacaaaaaaataccaaaaaaatgtatctgggcatggtggcgggcgcctgtaatcccagctactcaggaggctgaggcaggagaatcgcttgaacccaggaggtggaggttgcagtgagctgagattgcgccattgcactcctccagcctgggcaacaagagcaaaactccatctcaaaaaaaaaaaattatttgcatgttcattttagcaaaagactagaaacatcttttaacttatccttcattaaggggtggttatatgaattatcacacatccatccagtggaattatccgctactccctgtttaacagcagagaagacctccaagtgctgatgtgaaaatgtcccaggctacatggttgactacaaaatccatgttgagtagcccacgtgtgtaaaaaaaaatccataaacaaaaatatgtgcagatgatgactggaaaggcacacacacacacacacacacacacacacacacacacacacgcaaaaccctgtagcaggaaggggaggtgctaggagcccagaataaaagattgactttagtttagatatcctttttatgcagagaacactagctagtcttaaattatgcagagaaaaaaacacaatcaccacacaaacatatggaaatgtagtaggtatcctaaagaaaaacaaaaactggagtgaagaagttgaaaagaatttggataaatcaaagcatacactgtatgttctggaatggaaagacatggtattgtttagatgttttaattttccctcaaagtaatctacaaatttaatatgatgccaattcaaatctcaaatccattctttccaagtcttggcaaaagaaaatcaaagtgcatctagaagactaaacatttaaaaccaggcaagaacattttaaagaaatagattaaaagtccgggatggggtaagcggtagaacttgtcctaccatgtataaaaatagattataaagtcaaggtaatttaagtggtattgctctggaatatgaataaacagacatatgaatgttgaatgaatatgaataaaaagtccagaaatagacaaatgggcactactatctgtgtgcgcatgtgtgcatgcaatgataacactggcagagttgatattggttgtttcttcaccacccagcatacatgtccagcttccctcccccaaccctgcttaatagcagccaactttgtttccggtatgtctgtaaaaaaaaagtagcccatgtgtgactgaattcagtctggtaggacaggtaagcaaattatcatcctcctgtatccaattaaacactccctcccagctctttgactctaatgcaaacagacccagaggtaaagaaccataggaattgtccactcctgcagaactgcaccctggcaagttcagggttcccactgtaggccccagtctcagtcagatttctgagccaacagaagaagcttccttagaaccagccagttttcaagcctgatctctagcctccttgatgattcaataggccccactatcctcacaataaatggcccgtggctttcttagtaattgtaacttgctgcaaatgatttttaatgatctgggtgacatttcaaatcagcagggaaatactagagtattcagaaaatggtttcaggtaaactactaaactgtttagagagaaaaagttcaattcatcgagtagactgtaaaatactaaagagttaactatattaaaaaaaagcacaccataaccaggaagttattggggtagcataatcttggaaaggagacaatctttttaagcatgattctaaggtaagattacaaagagaaacattggtaaatttgaatatataaaaattaaaaagttttctacttttctgacaaaaattaaaaggcaaataacaatccagggaatatatttgcccaatataagtcaaaggattcaaaactataatatataaagagctcttataaatcattgataaatatttaaatctataactgagtacagaacacatacagacaaaacagagaagaaaataaaatataaatggtgcataaacatgaatatatgacataattacacatatatgtataaatacatataagcttatgtatatgcaattataaatgactaaaaagtttaatcttactagtactcaaagaaattcaaattaaacaatgaaatcatcttatatctttcaaattagcatggattaaaaagaataacaactttcagtgctggcaaaggtgtaggggaagagcattatcatatattgggaatataaatgggtaaacttccctaaaaggcactatgtcaatatgcaccaaatactctaaagatacattcatttttatcatgtatatctaattttaggagctgtaaaaaggattcaatttgtataagaataatggccatctctctaattgcaaaaagcagagatatggttaaataaacaatgttacattcatacatatagagtagtcactaccaataaagttgtagaatattttaaaacatggaacaggccgggcgtggtggctcatgcctgtaatcccaccaaggcaggcggatcacctgaggtcaggagttcgagaccagtctggccaacatagtgaaaccttgtctctactacagtataaaagttagctgggcgtggtggcccatgcctatagtcccagctacttgggaggctgaggcagaagaatcgcttgaacccaggaggtagaggttgcagtgagctgagattgtgccactgcacaccagcctgggtgactgagcaagacttcatctcaaaaaataaataaataaaacatggaacaatgtgatcagttaaaaaagaaatcacaaggcagcatgaagtggatagcacatttaaatacattaaatatatatgtatacatacatgcatgcatacccatacatccatatacacacacattatgcacagaaaagactggaaggacataatcaactgggtggtaggactgtgaagtgttttgttttttgaatttctatagtaaatgtataatttttatatatgaaattttgttttttgaatttctatagtaaatgtataatttttatatatgaaattttatatatgaaaggagcataccttttatgtgttgtataggttttgcaatattctatgaagaactcagggtaggtcatgtccacactgaacaggtgtattagtccattcttgcattgctagaatgaaatatctgagactgggtaatttataaagaggtttaactggctcatgcaggctgtacaggaagcatgatgccagcatctgcttgacttctggggaggcttcaggaaacttacaatcatggtggaaagtgaagggggagccagaaagtcacgtggccagagcaggagccagagagaaagcaaggaagggaggtgccacacactttaaacaaccagctctcgtgagaactcactccctcactatcatgagggcagcaccgagggaatggtgctaaccactcatgagaatctgcccccatgatccaatcacctcccagcagtctccacctccaacgctcgggattgcaactgaacatgagatttgggcagggacacaaatccaaaccatatcaataggaaagggaagcaaggccgagaaacagtgagtgacttgtcctaagtcacataaccaggaggtggtgaagcatggctttgatcctggattgctgactccaaatccagtactgtttgtgctgcacacattgcccccaagcaaatgaacacactggtttgtagctctgagatttctggccttgtatgagccaaggcagagggacacctaggatcaagttctaaagtgagggaaatattgatgattctgtggtaccatcaaccaaacagatgtatgtgagagtacatatctgtggtacatgatgttctttttatgtatccgtggaggtatagaaagcggtaagaaatagaggagaccaaatctccctttcctatacttccatgcagtctgcgatgtgggaaaacggtctgagattaagaccaggaggggtcagcccttcaagcttgggcaatgtgtgtgggctttctttttggtgtgaacctccagacactgagtttcccttcacccaatcactctgtctcccccacacagagccctgcactggaaaatgagagtctaagaaaaaaatggccagttccttgtaggtcaccagattttgctatactcatagcacctagtatttaggaataaaaaggctggccaagttatgaatacaagatggcaagttatcctttcagatggagatggggatccaggttgtgtcaattgtcaatcttaagggggtctacaccataccgagaatacttctgtgcacatcatatagggatgaaatctgatcaatgttctctaggccacattcaacagacaataacaagatgaagccccaacaattcatttttgtaactcagtgggcagcttcagcatcgaaactgtgccagcgacactggtcctgctggccttcgtagataagaatgcagagagcagcaggctttccagtggctgcccctgtgaatccaaacaacatggtcccaagccaagcaggcatggtcccacagcagaaaagcttctggtaattcagcaatcacttctcagaatcatagccacaggtagagcaggcagagggcaactgtggagggacatggctctgaaaggtagcctgctattgcttccaagacaaagaaacgaaggcccatgtccccatacccagggaaccacagtcctatcaggagtttaagtatattcataccagaatgcaaccaaacacactgcaatttctgtcacagccagatgtacctattacagtaccatgagctaagttattttgaaatgatcgttctatccaacaaacaagttgttgatcttctacaacaagctcgtccaacccaccacgctgcatgcagcccaggacggcttcgaatgaggcccaacacaaattcgtaaacttccttaaaacattatgagatattttttgtgacttatttttttttagctcatcagctgtcgctaatattagtgtattttatatgtggcccaagacaattcttctaacgtggcccgaggaagccaaaagactgaatacctctgttctacaatgtacacagcacactgtctacaattttctgaatgtggcccaacacaaattcgtaaactttcttaaaacattatgagttttttttgtgactttttttttttttttttttagctcatcagctatcgctagttttagtgtattttatgtgtggcccaagacaatgcttcttctaacgtggcccaaggaagccaaaagattgaatacctctgttctacaatgtacatagcacactgtctacaattttcctggatctgaaagaaaattctttttaattgagaaatgctaactatattgttttgatatattcgtcatccagcataatatgtacatcagcacttaaaactgacttgcaaactgatttttaaaaattcaatacaaataagaatcaatgcaacaaatgctaaaatataatagttactaaggatatttattccaaaatagcactacgttgtgatccttaaaaatatactactagtagctgatttacaagaagaaaaagttttaattgttctacttataaatcagtaagtgaattgttatctaacttatagaaataaatcagcttaacctaaataccctaaactagaaaacatcagaatgaattgaaagtgtacatgagaacctaagaatacagtaaaattatttttaaaattgctcttgtacaaaatcaaatcctatgacctttatgaaagggtttgcatttcattacttaccaactggcagccttctagggagttgactagctgagcattctgacaagagagaattgaaccagccaaattcagcattacacacactgcagaaagcagcatgaaaaaggttatctggaaacaaaccaaacataaaattgattattcacttggagaggctcaaaggaaaaatgacatggctttacaacagctttcatttattatacaacagttgatcacataattacatgaataacatgtatgtgttttaaaggaaagtggtaggttatttctcaaacttccaaattcatatgatctgaaatagaaaaagtaagatctgtaggaagccatagcaagctaccatgattttgtttaaaacctatgatgataaaatatttaaggagttaaacttgaaagactgtgcattatatactcttaacagtgacaagttacacattattaaaggaaatcaagtgaaagaagtatatttattagaaggcctttaggtttaatttttattacagaaaatttcatacacatgcaaaaccaaagaaaacagcataatgaaggcacatgtgtccatcacccaacatcaataattaatccacttacggccaactgtgtttcatttacagcccctaccatctgaattattgtgcaaccaataccaggcatcatataattttacccttaaatctttctaaaggaattgagaagctttctgaaaacatagccaaaatagtcatcatatctataataaataaaaattcattaatatcatcagatactgagttcacatttccctaattgtctaaattttttcacactttgaatcaggccacacaggatacaaagcaggtccatgtggtacaactggctgttaggaatcttagacagtctatgggtttcccatccactttttcctctgtgaaatttactgaagaaaccagttcatttgtcctaaagagtttcttacagtctaaactttctgattgtagtcctctatcattaaacatttctctagcctctgtatttcttgtaatttggtgattaaatacagaggtttggccaaattcagatcaataaaaggcaaatattgtctctctctcttttttttttttttgtgatggagtctcactctgtcgctggagtgcagtggcacaatctcggctcattgcaacctctgcctcccgggttcaagcgattatcttgcctcagcctcctgagtagctgggactacaggtgcgcacaaccacacccagctaatttttgtatttttagtagagacggggtttcaccatgttggccaggacggtctcgatctcttgacctcatgatctgccctccttggcctcccaaagtgctgggattacaggcatgagccaccacgcccggccaatattgtctctctttttgtgatgttagcggccatttttaatgatgacagactcattaatttattagggtttccaaaatagtgctagtctcactctgtcattttttctttatgaataagaatacatatagagacacagacttttcctcatcaactgttttgttaccctgaggtatagttcatatatgaaaagcaggatatatacttgactctttctgttcattttccaggctttaaaataattttaaattttgcaaaatgaactcaaggaagtctgtatgcttaattagcactctttctgcacctatgtaaataattaggccaaatctaatgaagaaagaccctttttgtgatggagaataacctttaagattaatctgatcaagaggcggggagactggcattaaaacttgttaaagagcaaaaaaaaaaaaaaaaaaaaaaaaaaaaattcactggatattctgtctaatgcacacttcagggttatttctgcctttcaatgtctttatgctatttcaaaactctgcataaaactgataaaactgatagtttatcaactgatagttgtataaaactgatagtagtgcaaatgattcttgacgatacaaatgtaaaggaattttgtccagtagaacgtaactgattattgccccactgatattggccacttttacatttatttgtaaatttatttcagcattcctgattgcttatatgtgtgcagtgtttgaattaacctttgaactgcttgtaacatcttactgatttcctcattaaataatgagttagacatagtctttgacacatgtctatttttttaaaaagctgattcccggccaggcgcagtggctcatgcctgtaatcccagcactttgggaggccaaggtgggtggatcatgagatcaggagttcgagaccagcctgaccaacatggtgaaagcccatctctactaaaaatataaaaattagccgggcatggtgctgcgcgcctgtaatcccagctactcaggagcctgaggcaggagaattgcttgaacccaggaggtggaggttgcagtgagccgagatctccagcctgggtaacaaagcgagactccgtcaaaacaaacaaacaaacaaaccaacaaacaaaaacctggttccctagcatcctccaaaattaacaatatcatgaaatagtattttgtctgtttggtggagaggggagtgagtttgagtcattatgagccaagaacttaaacacatttgatagttttaatcatctgcatcattagacagagtccactcaagttgacacctgggtcctttcaacacaactccagtagaccttgacagctatctggctttctgtatgagaagatagtacaggatcatcttacagttttctacccaagagacctataatcagccatttctccagtaagtccaggttccattcaatgagaatggtattcagataccataatttttgtgctacaggtgctgtttgctacttggagcttcattgttttcagttgtcagacatatcatgagttcacaattatgtttctgatttaaattcaacactactaagttttcacaatgagataccatctcacaccaggctattactaaaaagtaaaaaataacatgttagcaaggatgtggagaaaagggaacacttatacactgttggtggaaatgtaaattagttcagccactgtggaaagcaatgtggagatttctcaaataactaaaagcagaacgaccattcgacccagcaatcccattactaggtatatacccaaaggaaaatacattgttttgccaaaaaataaaaaaccccaccttcacccatatgttcaccacagcattattcacaatagcaaagtcatagaaccaacccaggtgcccatcaatagtggcttggataaggaaaattccatggtacatatacaccatggaatactacgcaaccataaaaaagaacacaatcatggccaggcgcggtggctcatgcctgtaatcccagcactttggggggtcgaggcgggcggatcaaaaggtcaggagattgagaccatcctggctaacacggtgaaaccctgtctctactaaaaatacaaaaagttagccaggcatggtggtgggcgcctgtagtaccagctactcgggatgctgaggcaggagaatagcatgaacccgggaggcggagcttgcagtgagccaagatcacgctactgcactccagcctgagcgacagagcgagagtccgtctcaaaaaaaaaaaaaaaaaaggaacacaatcatgttctttgtagtaacatggatgtagctggagtccatattatatgaattaacacaaacaaaaccaaatactatatattctcacttatagggtaggagctaaactttgggtacacacagacacaaagatggggacaacaggcactgaggactccaaccggaggttggggggaagagctgaaaaaccacctattggggtactgtgctcactaactgggtgatgggattatgagaagcctaaacttcagcaccatgcaacacacccaggtaacaaacctgcacatgtacctcctgaatctaaaatttaaaataaatatagtcatacataacaaaaaaaccgcaaacaaaactataaggtttttatgtaaccatattaattttacatctgtatctcctttcaaccatgccaaaaactatttctcaacataattaatctgttggatttaatttcacaatatccacacaacagtctcaaaataacaccaatacaactgccgaaaaaaatgactgaaaatagtttaacatttatatttctttttattcttacattacattctaccagaaatagtcaaattatggtgttttaaactcacatggttcctttatatgtggttacgctactgatcaggaacccaggttcattccttttatttcattttttcttgtttaagaattgtttctaaaactgagtttcatttctaattacataaaatgattccaaagtcaggtccataaatgaagtttcacataagtctggcatttattctgttcctccactctatttcctcccatttattaataggcaagcatttattttttaattttatattttatcctcccatcattttttagtaaaagtatataatagtagcataatacacacattttctttacttactttttttgcacttaatatggtgaagatcactcgaaataagaacacacaaataaccctattcccttctacaactgcctaatacttcatggcacagatgaatcacagtttatttttttattatttatttatttatttatttatttatttatttatttatttatcttgagatggagtttcactcttgttgtgcaggctggagtgcaatgcagcgatctcgactcaccgcagtctccacctcccaggttcaagcgattctcctgcctcagcctctcaagtagctgggattacaggcatgcgccaccacaccggggtaattttgtatttttagtagagacggggtttctccatgttggtcaggctggtctggaacacctgacctcaggtggtccacccgcctcggcctcccaaagtgctgggattacaggcgtgagccaccgcgccaggccaaatcacaatttattaagccagatccctactgatgaacatttgggttatttttagtcctttgctatttattataagtagtgttgcaacgaactgccttgttcatatatctttttataggtttcccagcatggctttgggatatattcttagaagtggcattgctggatcaacggataaatgtttgtttaatgtgctagacattaccacattcctcatcatacgactggtactatttttcattcccactaacaatgtatgagaaggataagatcttactttttctgttaataccttaaaaatgtaagctaaattaaatttaggaaaataactggtattaccattctctaccgtaactataatgtatacccctcagctgtagttaaatttattttccttaaaaatgtacatgggagacagaattcataagaggatattttgttcatttaggaactatttcaagttcataatgttagcagtatctcagcaatggttttaataactgcagagtctgacagcatcccttgggaaagttaggtcacatagaaagggccaactttgctgggcgcggtggctcacacctgtaatcccagcactttgggaggctgaggcgggtgaatcatgaggtcaggagatcgagaccatcctggctaacacggtgaaacccctgtctctactaaaaatacaaaaaaattagccgggcgtgctggcacgcgcctgtaatcccagctactcaggaggctgaggcagaagaatcgcttgaactcgggagatggaggttgcagggagccgagattgcaccactgcactctagcctgggtgacagagcaaggctcagtctcaaaaaaaaaaaaaaaaaaaaagaaagaaagaaaaaagaaagggccaacttaaatttttcatattagaagttacggcagtcccatatcattcaaatgatatgtaaataaactggcctgcacagctttgaaattgaggtcaaaaaatagttgctgaaaacatcacgaaagcaaacctacacagaagccaacaagagactaccctgagacttagtaagtgctgaacaacacagatgctacgaaagtcaaggaggtaagagacaataagatctttttgcctgtttattgtttttttttaattgtggtaaaatatccataataaaaacgtacttgcattttctaatttgttttttaaactgtggtaaaatattcataacatgaagtttacctttattcccatttttatgtgtgcagtttaatgacattaagtatgttcacactgttgtggaatgatcatcactatccatttccagagaatgttttgtcttctcaaactgaaactccatacccattaaacaatcattccttatcctccctcctcctagcccctagcaatcaccaccattctactttctgtcccttgaaatttgattactctagatatgttacatacgggaaatcatacagtactcttcctttggtgactggctgatttcacttatagcataatgtcttcaaggttcatccatattgtagcatgtgtcagaatttccttccttttcaaggctattcgaataatattccattgttccagaaattggtcctgccaatgaaacaacttttctgagtgggcaagaactttgaatcaactatttcataactctggaagctggctgaacacttgtagcatccagagggataatctgataaagaaagaggttggcattcaaggaaatctccatcaggtctttggctgaccatggatataatggaatagagactttagtgatcacacacaatgaggaataaaatctgctcaaaattagtttggaaaagtcactaaagaaatggatggctacagctctcaaaaagcagttatcaggcatcattaaggagggaagataatctgatttcagagtcaccacattacaatattcaaaatgtccaattctcaaatatttccttcttgaccaatctctagcacttgaacaaaatattaacatagattctaacagctcaaggccacatccctaggatggctctagctccccctaaagtacctgcctgagaaaattcaaggctgccaaaagagtttactgttagttccagccgacacttgaagacaccctgtgtcccagcatctgtgggagggtaggagcctaactttgataagcactagctaacaatcccagatgggtttcacacaggccaatccctactttccacttttggtaatttttcacttccttgactttactaaccaccccctacaccctgctcaccctccctcctgattcttcattcttcctttaaaacacctagtgaagcctggcacagtggctcacacctacaatcccagcacttcaggaggccaaggcaggcagatcacttgagcccaggagttagataccagcctgagcaacatggtgaaatcccatttacatatatatatatatgaagaaaaaaatgcaattattaaaaaatcaaaacaaaacaaaagcccagaaacctctgtacaaattgaagttgagttcagttaacaccgggctcttttccatagtgtaacagtttattactcattaaaatctgccctttccgttttaactggtgtccagctttgtgtatctctggcagaaacacatgaattaacaaaagtgattcaagacaaaatagaaattctcaatatctgtataacaaggaaggagactgaatcaggaatcaaaaatcctcccaacaaagaaacgtctgggcctatttggggtctctggtgaatactctcaaacatctaaggaattaacaccagtcttatgcaaactctctcaaaaactgaaggagagggagcacttcctaactcatttcatgaggcaggattaccctggtaccgaagtcagacaaagacactacaagaaaagtaaaccatagactaacatcacttatgaatatacacagaaaatcctcaatacatttcagaagattaaatcatacaaagtacctactctgaccaaaataaagtgaagttaaaaatcagtaacagaaagaaaactggaaggaaacaaaaggaaattggattctactccgtgaccaagtgggatttacttcaggaatgcaagaaagtcgatcaatgtaatacacaacatcaatacattgaagaagaaaaaaaagcacatcatcatctcaacacagaaaaaccatttgacccaatttgagaattcttatctttcagagacacgtgccaaaatatttacaggtaaaatcatatatggcatttgtttctaagtaatctggactagggaggaatacaaagtagttgaactgggtggggatacagacgaaataagattatccacatattgaatcttgtacctcatctttctactttcacgtttgaaattttctaaaataaaaaatttaaaaacagatgaaaagacattttaagagaatacttttaaaataaggcaggaaggaaactggaaatatgttaatataatactaaaaagcattattaggaataaagagagtctaaaagcaacaattctccaggaggagataatgatgctaaacctgtttcgcctttacaaatacagcctgaaaatatataaaataaaaaacaagacttaacaaaatcataatgagagatctttcccattgcttagaaatagattacgcaataaaaatagactatataatatttgaacaacacaattaacaagctttaggtaataaacatactgtgaacatatcaaaaacacgtacacagctgcttgggaggctagcgggggaggactgcttgtggtaaggagctcaagaccagcctgagatacatggcaagatcccatctctaaaaaaatagttttaaaaattagctaggcatggtggtgctcgcctgtaatcccagctgatcaggaggctgaggaaggaggatcgcttgagcccaagagttggaggctgccgtgagctatgattgtgccactgcattctagcctgggcaacaagcaagatcctatctctaaaaagttttttaaaaattagccaggcatggtggcgcttgactgtagtctgagctaattaggaggctgtagcaggaggctcacttgagcctgcttctactgcactctagcctgggcaacaagcaaacttctatctctaaaaaggaaaagacaaaaagaaaacatactgaattcacttcttttttaaaggacacttggaacataccaaaagctaaccacatattaggccaaagaccatgttaaaatattttaaaaactgattttatacgcaacattttatctcactcaaagcaattttttaaaaaatcaaagaccaacaacaaaaagcatagttcaaatccaaatattggaaaatttaaaaagatcactcacttgcaattagaatcaaagacaaatcaaaacagatattaggaaatatttagcattgaatataacaaaaatacatctgagaatttatcaaatatgagcaatattgtaaagataaatatattgccttaaatgaattagaaatgaaaatcaattgactaagtatctactccagaaataaaaaaaaaaagaaccactaagtaaacccaaggaaagtaaaaagaaaggaaacataaagtaattaaatcaaaaagggaaacaataaaaaagatcaatacaacaaaagtttcttgaaaatactgataaaataaataaactcccagcacaaatggctccagaaaaaaaaaaaaaaagggcgaaggcaaaaaataattctgggagtacaaaaagaaagagaatctataagtaaagatgcatggtgttatgatatatacatattggtttccttccatggttcctgtttcctaactcccataatcttcgttatactgttggggttctttaggcctcaggcaacagaatctctctctctgaccttctcctgtctttctttcatctgccccagtcaggcctctgattgtgggtcaaaagaccctcatttcagaaaagagtcctgccccaaaccctagaggaaggaatgctacacagagaggccaagaaaactctgagcagacaggccttgctggctttagctcgtgtgcgtttttgtccaatcacatttctgcacagttgtcaatcatgcctatgtaatgaagcttccataaaaacccaaaaggacagggttcagagagcttccagactgctcaacatgcggtggttccggtagggtggcgtgcccagggaaggcatggaagctccacacaccttccccataccttgccctatgcatctcttcatctgtgtcttttgcaataccctttataataaaccagtaaacgtaagtgtttccctgagttgtgtggactgctcttgcaaattatttgaacccaaagaggacatcatcagaaccccaacttgaagaccattggtcaaaagttccagaggcctggacttgtgactagtgtcctgagagtgggcagtcttggggactaagccctcatcctgtgggatctgacactatctccaggtagatagtgttggaactgaattggaggacacccagctggtatctgctgcttcctccgtaggggaaaccccctacacatttgatcacagaagtcttcttctgtgttgatgattgttgtggtgtgagagcagaggaaaaacgaagtttgagagttttttctctaaaaaagatgtaaaagaattatttttaaatcaaaggacaatactaagaaatgctttctactaattatatcagaaaatatatgaaaacatcttctagaaaatacaagtgaccaaaaccaatttcaaaagaagagaaaacctgaacataatcttgagaaaaatatcagtaaaaatctacccacaaaaaacaccaggcccacagcctttcacatgtagatttgttccaaactttcgaaaacatctaatcttctgataacagggcaaaaggcaagcttcccaatgcatttataagaccaaaaggttttctatttcctgaacaattcagtgcaatagctgttaagtgggacagaacaagttccatgtcctgggagaggccaaggtcacctgagtggggttagagctctagcaatgggtggagggtgactgcacagaaaagccagttatgtgggacattggagcccacgtgggaagctaagcgcacccatgtggatggtgtggcagagaggatagtggattggttatttataagaggaattaatcaaataagtaaatatggtaaagataataggtgctaagtttctcaaaccagaatacacacagcggtgctgtattgcaaatggcagtatcagtgtaatctcatagtcttcagtgctgtgtagatgactgatagataaatatcctataacttcatcacctagagggctggaagcaatgatatttcccataggcatgagcaaacctagcaaccttgtttctgaattccattctccaccaaaagaaaccggagctctttaggaaaaggattaattccaggcctagggcagggagagttaaagtctgaactcctgggtgggcgcggtggctcacgcctacaatcccagcactttgggaggccgaagtggatcacgaggtcaggagattgagaccatcctggctaacacggtgaaatccccgtctctactaaaaacacaaaaaattagctgggcatggtggcgggtgcctgtagtcccagctactcgggaggctgaggcaggagaatcgcttgaacccaggaggcggagattgcagtgagctgagattgcaccaatccactacagcctgggcgacagagcgagactccgtctcaaaaaaaaaaagaactccctctctttttgtgccaacaagcaaggaaatgctcaataaatgatgttggggcatgttaaagatgcaaaagccagctttaaggggctcccactggccaaatcagggacaatttgagtattgaaatatgtaatgataataaaagattagataataagttaatgataataagagacccatgggtctatacaaagtctcaaagtgtctccacacaagttatttgtttaccttaaaggagaaaactctgcagtggaggcacatgacagaaatccaccttaaccaaagtgatcaaggtttcaaaataacaggacaaattgaaattttgtgccacctgataggatccaaaaataacacagcattgcttctgtgatattcttcccaaagatgcataattcaaatccaatcatgaagaaacagcagacaaaccccagctgaaggatgttctacagaaaacaggcccgtattcttcaagtgaaggtcataatagtcaaggaaagacttaggaactactggcaataggaaggagactaaagaaacataactaaatagttcagggaacaaattattttgcactgggcttgcaacttttctgtaaatttgaggttatctctaagtaaattagcataacctcaaaaataatgataatataggaaaattaaagactaacccccccttatgtcaaaagatgcaaaattatacattttgagctatatgtatttaaaaattttatcaacaactgtttgtctccaaaatgcaagaatgtttagatatcagaaaactgtatgttattacaccaaattatatgccccaaaaaacaaatttacagagtaaataagacattttaatcatattagcaggtaaataaagagcatatatacatccaaagtcattcatagttttttttctgaacatctctaagcaagctaggactgaaggggtaactaaatagcccaataaaaggtatttataggggaaaaaaactcttaacagcaaacatcacactctatggcaaaacttaaaattatttcctttaaaatcaagaataaggaatcagaaacatccttagagcctgctgtaactgcttcttttcaataatatattgcattttcagccaatgcaaaaaagactaaaataaaaggctttaagaattgaaaaagaagacaggcatatgatgctaaagaattataggctgggcgaggtggctcatgcctgtaatcctagcactttaggaggccgaggcgggcagattacctaaagtcaggagtttgagaccaccctggccaacatggcaaaaccccgtctctactaaaagtacaaaaattagccggacgtggtggcgggcacctgtaatcccagctactcaggaggctgaggcaggagaatcgcttgaatccaggaggcagagattgcactgagccaagattgtgccaatgcactccagcctgggcgacaagagcaagactccgtctcaaaaagaaaaaaagaattacagtatggtatttgcaaatggatagcaaataaaccaattcagtcctagccataaatttatctatacatgggacattgctacaaaatactgagtgtcataaatcagtgtggaaagtataaatgatgaaaaactggtgctaggctatccatataggaaaaatacaaaaactatttccatacctcacatcatacacaaaagcagattaaaagcataaaatgtgaagatcaaaactttgaacacttagggaaaaaaggcagaaaacatatttacaattttaggattaggggaattttttaaagcactatacacaaatgtagctcttataaacactaatgatcgtaacacatttaggtcaaatgatctgtatgaccaaaagaagtgaaaatgtgggagaaggtatttgcactagatagatagagcagaccatggattaacatgtagaacatataaagatgtcttacaaatcaatagaaataggtctaagacatgaaatctgacactcaaaaaggagtgagagcaaaagataggcagatacttaacattactagtaagcaacaggtataagttaataccgtaataaattatcatttcacactgtaccagaatggctgaaaagatactgaaaaggccaagtgttcacagggggtgaaggtggagggattggtaaacaaaaacaaaacaaaactgtataaaatgttgatgggagtgtaacttgacacaagctcaagagcagcttggcaatagtccttgattgctccatttgtttctggctggagaaactcacacatgtgcctaaagaagtactgtacaatgcctgcaaatctcaaagaactggaaagaccttaaatgtccagacattaaggaatggatagttatttttcccccataaaagaacaattaaaatgagtgaatcaggtctacatatatccacatggctgaatctcaaatacataatggtgagtgagtacagcaagttgcataaggacacacgtaacaccgcttatataaatcatgaaagcccacaaaataaaactctatattggttatgtatatatacatgtatagtaaaattataaagtcatacaacagcccgatagccacagacttttgttacctctggggagggtgagaaggaaaagatataaggccttgatgtggcctctgatgtttcatattttaaaatttgaaacaagattatcgatggtaaattgctaacacctctgagaaaagcggggggaattttgcctcagatataactggtggtgactgctgggtaataatttttattatacaggtgagaatgcgagtatcagagggcatgaggaggagaaagctgagtcagggaggtaaggggaccaggaggcaggaaggagtttatacactgaaataaaatgcagatcaagaagaaatgcctgtaagggccaaacatattccactgatgaaacaaatgcaaatcccaattcaacagaatgaaataaaacccagtaacctatcacattcctccatactcactatagactcttttaaatgacattccgtccagtgttgatgaagttcacttttttccccgagttaaaaatatttgccttatttcaaggttaatttgcagcacctccccctaaaacaattaacttatttgcccactgaataaaacgtgttgaatctctgcattaaaaacagcatctgctacacgtaatggaggaacacaatgggactatgaactcttctagttcatttagtgcataaaactattatatagctattatttttctcattttacagataaattgagattcagagagcttaaaacctacccccacaaccaccatgctgacaagttagcatgagccgtaattcaaattcagtttgccagacagccccaagacccatacccttttccctatacctaactccctaggaggtagatcttatgtcctgctcttatgttctatgtggggcacactcaccatacacgttatatttccccatacaatagagtgagactagaggactatcttttgaaccaggaattgctctcctaggaatgatttggaaaaaaagataaagaaaagttatatttaaaaagtggcagctccagaccaaggagaataaaaaataaaaacattaaagaataacaaataaaattctccacatcacggactaaaaccattttacaggtcaagaaacatctgcatacaaactaaggaacctatgtaaattcatatactagttatggtggggccaggatctcaacccagacagtccgattcccaaacaggcatggttaatggttacgctattgttttataagcctttttgagatccacagtgagaaatatatttcacctcatgatcctgattttgtttcacacaaaagtgaaacaacttctacaaaacagcattgaccttaatatgtagcaaaaactttaagatgttgatttccagtcatgaaattctctcatgacccacgatttaaaaaacacacaatgcttaagtgcttcaaaaatacagtatttattgtaataactacagtagcaagaagaaaaaaacgaagtggaactacgtgtttagcagcagagctgaataattatgaatataaacaattactattgggagaaaatacattacactcattgcttggaaccatgaataatacttatatatgtacgaaatatagaaaaataaaataggttaacataataaggatataggcaattattttttttaattttataaaaacttttatttttccttacaaactggggtagttaggagacctgataatagcttttttattttcttggcaccaaagcaacttacttatgtgttccttcttgcattatctgttccagatcatagtcaagttttccaattcgttttactaagctagcaaaattttttataccaaaaagagtaaaatcaaaacaaatgctcctttgtttatagatgaaaatctggagcaaaataacacaacattaaaaaaacaaaactttgcaaacacatcctaaagctacacacattgaagcgtttacagcaatatgctccctgggttcgttctcccttcccccaatcctctaaactgtgcctttgggtctcagacccttgtcccgggggtccctctgaatccacctttcaagaggatggagctgggccactaggctgaggtctggccctgttctcctcatctgccaaagcctcacagtactgcgctggccagtccttggggtcttgattatggaccttggccacaaacttaagaactttcatcttgctggtttccaggttggttcgcgggccccactggaattcgtagtcgacggggtcggtgtggggtatccgccggtattccaggtaacgctgtcgcacaaagtcctcagtaatgagtttctttggatctccgaaaattaaatgcttcttggtggggtagacccctaagcgccgcagaaagtcccaggcttcagtttccttgatggtgttgcccttcataaagatgagccctaagacgatcatcaggaggcccgtagtgggcgtgccttggtcacccctcatctcggcatcctcctccacaggctccagggtgttgatgaggatgtaagtgttgctcttgggttcaagttccaccagcttatacccgaagacgtactggaggcgctcggcggcccgtttgaagaggtcggggaagatgtccttgtagtccccgatgacgtgcttcagtatgtcggcccgcttgatcggaatcttcttctggtctttaatcagcaagaactgcaccagctcggacactttcagctccagctgcttctggctcctgggccccacggcgggggcggcctgggcccggcgggcgccctgaggcgaggggccctgcgacccctgcgagccgcccggcccgcgggacgtgctcggggcctcctcggcaaagccgtctctgagaacccgggcgtcttccccggcccgcgaagccccggggtttccgctatggctccagtctctgtccctctcggcctggccgccagagcggccccggttcctcggtttttgcaacatgtctccggcggcaggtgccggcgcacactccggtaggcaagcagccgcggcggggattgcgggtcggcgacccgctaacgccggtgcctggaggcgcgcgcagtgtcggctgagactgcgtgctgcgtcatgaagcctgcgccttgcgtcagggcggctgggcggtgcgcctgcgcggctgcggcgggtaccaaaaggaacagcgttttccgtgcagccctgcaggtccgggcgatgatttttagtatagtgaagtgttgttaccaaaccatgcaaacagagagcgagaaccgaaactcctaaacaagtgtgtcgctaaattcagaccacacaggctcaggcaagttttacagacagtattatgagtttctaaatcgggagcatttgtaaacggaaagaattcagaggatgaacgtgtgagaaaaaaaaaaggtgaagaggaagggccgaccgtggaagtaaagtaaaaacatttatttctacacaaaatgtagaaggacataaaagacccagagggctcttagttttcgtccctccacccaatttcataccctccatcccactgcccccagttactttctctaatgccccgtggagtctgttaaaaaccaaagtcggctgcaggctttctgcgcaagcaggacttcagtttcactatttccgtatttatattctctgcattaaactcctttagctagacaactatgagaagaccacaaaaaacgtgtcagtattaggtaaatgttttagcttggtcacatgggtttatcttttggaaaacaactgctttcgtcacaaccacaattttagcagaaatgggtaagaggaatgctgcaaacaaacgtgcactctcaagagattactacttaatttggggcatcactgatcaagaattgcaataatgtggagctcttaaatttcttaattcataatatattagctttgaggaaaaaaaagagaacactgggggatttatctctcatctatgatgtgatatacagtctctactgtatattttaattgtgcaactcaagtagccaaaatgagtcatttcattaactcaaaccatcagcagtctgctgccatgacttctacagatcttagcaaatttgtttcttctctatttacttgcaaagaagaaactgaatttccctgtgtctttttaaagctacccagaaagtggataaactcttcaaagaaccaaattgagttcctctttaatgcaaatatattcaaaggaaagcaatttagaacacattatctgagtaatagcatcaaacacaaccttattaaaattttgttaattgttagtagcataacacttttgtttgtaattcagtaggaaaatgcaatctgataatggcactggaactgcaatagtaaatgtaaaatcatattccatgaactaatgcaagtatgctaaaatctggtatgcaatgagtaataacttactgttccacacaagatgcaactatatcctcaggcatcaattttaatgacaaaggcctactatgaaaaacaaatatattatcaaggcattcatttttttacaatgagaaaattcatctgcttcagtttccttgcaaattaaaatctggacttaggttcatagaagcttcctgccatctagaattctgcaaaaggtccctactgcaggatgtggatgttgtattgagggaatagagagaccgtctcatattgttttatattgttttatactcagtacctgttttaagaaaaaacaacaaggaagtaaaaccaaatacaggcagcccagcgccaggcccaaaaccaggcctgggcctgcctggcctaaacccagtagttaaaaatcaactcataacttagaaaccgatgttattcatagattccagacattgtatagaagaacattgtataaagaacagaactgccctgttctgtttctctctgaccaccggtgcatgtagcccctgtcacataccgcctgcttgctctgatcaatcacgaccctttcatgtaaaatctttagtgttgtgagctctttaaagggacagaaattgtgcatttggggagctcggattttaaggcagtagcttgccgatgctcccagctgaataaagcccttccttgtgcaactcggtgtctgagagattttgtctgcggctcgtcctgctacagtgccttgagtcaaaaaagttcagtgaccgagatataaggggaaagtggaaaattagataaaagctattgtcaacagttgggctggtttttcagtgctctttcttgctaaggtattcatgtacgttaccaagcagcccaccagtcagactacccctgtcactgtgaaaatcagcagtgtcctccagcagcacgcttacctagatagcagactgtcattactcaagatagaggagaagagataccagtttttaagtctcaaaacatctctctacactctttccagaagaatgcaggtgagaaaatgcagacataaaataagagtattagaatgaagttttaggccctgcatggagaagtcatccagacccacattccaccttggattgatactggaagccatggatgtctggggagaaactgtggtgataacaatactaacattagtaacaataaatataaccgacaacagccaatgattatagtagttgctgctccatctccatgtctgcagttttactttctgtggtttcagttacctgcagtcaaccacagtccgaaaatattaggatattttcaaagagaaaccacaatataacttattacactatatttgttctactttattgttagtgtcaactgaaggatgacgaggttcataaatttggaaagagctttatttctcataaagggttgcagtctgcggggcggccattccaacaggctaggaagacaacctcatgctagaagccagaaacagacacttcaagggagggcaaagggagcaggaatctatgcagaatggggtggccaaatatacatatttaataagctataggaggagtcatgaacatttatgcaaggagaaatgtgcatatgcgcaattgcacttcatgtctctccctgggacccatattccaaaattggcagtgttagcatgatccagggtaggagttttcagccctctgacatcaaaaggtgaagtagaggacatgaaaaccctgactgcatgtcttccatagactggccagaactactccatggttggtggtcttttaccaggaagaactgctggtcaattgtgccaaaactgcaaaagggaggggcagcatcaggtggttggtttataccagcagtggagtcttttgaaagggctgatttctgtttagctcttagggaagaaagcctaatggcatttagagcgggtgagggtttccaaggttattcggggtccccttggccaagagggggtctgttcagtcagctggagggcttaagatttcatttttctcatcaattattgttaatctctattatgactaatttataaattaaactttttttttttttttttgagatggagttgcgctctgtcgcccaggctggagtgcagtgtcacgatcttggctcactgcaacctccgcctcctgggttcaagagatcctcacatctcagcctcccgagtagctaggattacaggtgtgtaccaccacgtctggctttttttgtatttttaatagagatggggtttcaccatgttagccaggctggtctcgaactcctgacctcaagtgatccatccacctcagcctcccaaagtgttaggattacaggtgtgagccaccgctcctggcgtaaattaaattttatcataggttcgtgtgatgattaatgtggagtgtcaacttgattgaaggaagcaaagtattgttcctgggtgtgtcagtgagggtgttgccaaaggagattaacatttcagtaagtggactaggagaggcagacccacgttcaatctgggtgggcaccatctaatcagctgccagtgcggctagaataaaagcaggcagaagaacgtggaaggacttgacttgctgagtcttctggtcttcatctttctctcatgctggatgcctccttcccttgaaagtcagactccaagttcttcagcttttggattcttggacttacactagtggtttgccaggggttcaagggtcttcagccacagactgaaggctgcactattggattccctacttttgaggttttggaactcagactggcttccttgctcctcagcttgcagatggcctattgtggggcttcaccttgtgatcatgtgagtcaatactctagtaaactccctttcatatatacatctattctattaattctgtccctctagagaaccctgactaatacagtatgtatctatgcatagggaaaaacattgtggatttagggtttggtgctgtccacgatttcaggtatccactgagggtcttggaacacatcctccacagacaaggggggactactatacaaagtgaatggtgggtcagaccttattccaggtggtttacaggtatgacttcatttaatccccacaacaaacctatcaggcatgtgcatttattatgtttctcttctcacaaataaactgtcacaggagaagattattaagttttgaggctctatagcgagtaagtggtaggtgtgagatctgaacacagccaatctgcctccagagagtgggcttttaactgtatactgattcagagcaaacatagacatggtgtccttgaaaaagtaagggctttgggatcagatgaactaacattagaaacctgtacgatactgacactcctcccggtttaagtctccaagtcaacaaaatgaggcctaaacctggcatcaggggattaagtgagataggtttacccagtacctagcacagtgcctggcagggtagtttgataacaatttgcttctttccagggatttctgttaaggaaaatatttgaggactacacaaagttgtatatactgcaggggaggcaaaaccttccctccaccctcgaagggccccagctggacctgagacttaaactaatataaaatagattaacaggagaaaagcattcaaacttcatttaagttttacaggacacaggagcgcttgttagggaaatgaagaccgaaagaggtggcaaaacctaaatgcttttatatttggttgaacaaagagaggtaattgtgggaaaagtaaattatgtggggaggataaagggagataattattttaacgaagttgtttgtacagaattcacttggctttgaatccccattgagtaatgtttctttcctcttggtacagtaaagctatttttcacatgggagtttttatctcctgttttcaggaagaaaagaggaaattcaaatgcccttcttgcatctgctatttttcaagtgcctttagctcaaagtaatccttatgccaaagtggcatattttgggcgggcagcatattctgccatccttcagtagaacgatgagaaagatgttcactgcagcaaaacacatgtacacaagaatcaaaagggctggaaagaaatatatatatcaaggtactattaaagttaatttgcttttaaaaataaaaatcaaccctgattttcttgcttgggagatgaataaaaaatatattttcaatgaagtttaacttcaaagtgacactatgccatagcagctatgcacattcacatgttcaatacattcagtgtgattcgaatatggcatttgtgactttctgttcaggcagtgaagtcacaaagacaagtggttaaaaaagaaaaacattttcaaacactttatgttaatgaccttcatgctttaattactagacccaaaagaaaaaatcaaaagtctttgaggcaaaagctaagctagctaagatttcaagtgcaaagaacaaggaaatgcctactacaaattgctctttagatgtttatagtaattaaatgttttattttgtcttttcgatagcaaatgcctgccaagaaactctaatcatctttattatctactagattctcctcttcattcatggtatttcttgtgaatcagaaaaaggctttaatttttctgacagcaacacagtgctaaaagcaggtgaggacttcttaggaagaaaggcaatgatcaaagcatgcagccaccacatatgagctgttctctgccttttccagtggaagaaagtgggccaatgtgcagcatgtgagcaagggagttgggaggcaaatactattttggtgggtagacagcaggaaaagcaatccagacatcttaatggttgcaataaagtcccttgtgtccacacatttacaacagttatatatattcattcatagcaaagatccctcctgcctaggtcacatggtagactacctaataacactttgtccctcataaatgaatattttgatgaagcagcaacagagttttccttggctggtggaagcgggtggagaggtgagccttgacaagatagtgctttccaagcattgcagccatttggcccagaagcctggtcttagactctcttttcaagaaatgcatcttccagttatccagggccctttacttatgaaaatcattagggcctattaagttataaaattacaaacatccaaggtcttgatagtggtcactaagattctcttcgtttgcttggtttctaatccctttgttctgtatcctttccctttagaaacagcctcttcccacctttaaaagaccttagtatagggctgccttcctttcctgagtgcacaggattcaggccagacacagtgactggttcagaagttcagtcagcatccttccaggacattcagacagattctcgcccctctgagctcacaagctgaggggtgatgtaagcctagccacttgtgcccttgcttctgaaaaacctgcctcagggcgaagccaactcaaaagagatctaagagatgggaaacaatcttaatgctgccatttgaatccctggatgctgagttcaagatcagactcctggagataatgaattactaaagcatctccttttgcttaatctgctttgagttggttcctgtcacttgaaagtgaacaaggtctggctaaatcagtagccaatcctattattcaggggaaaaaagggtagtaagaaatgagactttggagctagggaaggttaaaaccaatgaggagttttgaatataatgagaggtgaattgaaaacaatatgacatttttgttatgtttcttcccagtgttctgtggttggggaatgtgctcatcattttagttggtggcaacaggggtaagggagagacaaattatgaagaactgtacttttccatatggaaagtatatatgggccaggcacagtggctcaggcctgtaatcctagtactttgggaggccggggcaggcagatcacttgaggtcaggagttccagaccagcctggccaacatggcggaaccccatctctactaaaaatacaaaaattagccaggcctggtggcgggtgcctgtagtcccagctactcgggaggctgaggcaggaatcgcttgaacccaagaggcagagcttacagtgagccaagattgtgtcactgcactttagcctgggccacagagcaagactccgtctcaaagaaaaaaaaaaaaaagtacaaatgagctaatcaatctggtgatttacctttgcagaaaggagttttacacaatttggaatataaattaaagcagcggtccccaacctttttggtactagggaccagttttggggaagacaatgtttctatggaaggtgcgggagtgggagggtggtttgaggatccccgcctgcagttctcagtagggctcacatccctatgagaatctaatgctgccgcttatctgacaggaggtggagctcgggcagtaatgctcactcgcctgccactcacctcctgctgtgcggccaggttcctaacaggccacgaactggtactggtccacagcctggggtttgggaacccctgccttaaagcatctcctactctaaagtggctgtgttctccatatttaacccagagcacttccccacttgctataccacgcaagatgacagaaacctcattcttccagactacgctttagcctaaagtagagatatatgcacaggacagaggtatgtccacaaagagagctgacaaagctaatatccagacagggacaatgcgaataggttatgagaaaactgaacacgttgaaatggaaaaaaaataaattagagaaaaaataaaaatattcaaggcagacaagaaagaccccatgtatacataactggtggtcttgagggagataacaaccataaagagagaaacaggtgactgtaggagtcctggggagctgggtttacacaggccccgcctctctgatcccacccccaccccactgcagctccctcccttggactaataaccacagcaagcatgcttccaggactggagggtaatcagaggccatgggttccccaagatctgcagaagagatccagtacagggttcctccctccctgagacacaagtgagagcttagcaatgaagttgcatgcggagaagagggcttgccccttcccaaggaagtcctgggaaaagcaaggactgtgtggtacttgtggggtctgtgctggcagaagcccgtgtctcccttctgagagagtccacagctgtcccctttctgagaatagtcctccaagaccctgtcccaggctgttgttctttgggagaggcaggctaactgctgccaggcttcaaggttgggagagccagcagtttgccccctgtgaggcctgggctccaagaggcccttcatagtacttcaaaaggcatgtagacagtgtgccctctgatgcatcgtgaccataaaagcaaaacctgctgggcctcttgctacttgccacctcatactttttcagtgactcccaacaacatgactcacagaggaaagggagaagcacagaccccattccagttatcccactggatatccttggcctcttttctgcagatctgttgaccacagatgtaagaatttatttctggagcctcaattctaatccattgctctacatgtgcactggtttcctggggctgccacagcagaataccacagacttgggggcttaaacaacaaagtgattcctcacagttctggaggctccaagtctgagatcaaggagtcggcatgtttggttcctcctgaggcttctctccttggcctgcagatgaccacgttctcactgtgttctcagctggcccttctctgtgcatgtacatccctggtgtctcttcctccttttgttgactataaggataccagtcctgttggaccagagccccactgtaaaggcctcattttaacttaatccacttaaataacttatttccacacacagtaagtctgaggttgagtcttttgaattctgggggagacactgcagcccatcacgtatgttgacgtgtgccaccgccacactgcctggttactgcagagtgttagtaagttttgaaattagaaagtataagtgctccagttctgttatttttcaggattattagggctattctgggtcccttccatctccatatgaatttgagaatcagcttgtttattcctgctaaaatttagttgggatttttttttttttgagatggagcctggctgtgtcaccaggctggtgtgcagtggtgcaatctcgcctcactgcaacctccacctcccgggttcaagtgattctcctgcctcagcctcctgagtagctgggactacatgcgcacgccaccacactcagctaatttttgtatttttagtagagacggggtttcaccatgttggccaggatggtcttgatctcttgacctcgtgatccgcccaccttggcctcccaaagtgctgggattacaggcatgagccaccgcgcctggcctcagttgggattttcacagggctcgttttgagtctgcagatcaatttgggtagtactgacatcttaaaattaagtctaccgatccacataagtgggatgctagttaatatggacaagtgaatttattactcctccaaaaaactattttcacaaactttatatcaacatgagaaatcatgttgtatctttctacctggagggagcaagaaagtcaggtggtgtgccttttgtacatgggcaacccaatttcttatctagactttcttttgctcgcctggaaaaaaaaaaatgaggtattgcaaaaatgtgataattgctttccttagtatgaaaaactgttaaaatgagtaaagcctgtgctcaactagaattctcacatttccgttttgatgtatccgcatttcacagtaaaaaaaaccctcagttatgtacatatgtgatcctgaagtacccatgattaaaaacaaatatttcaatctacaatgttcagttctattagatcattaaaagacgtatctctactcgcattctctgaaaacgtgtaaatcatgctcagcatagtgacaactccactaggacaggccgaccaactcatttgttacaaagtctctggccccctgagtgaggagcccccagaaacctaatgtgaaaggaaacttcggttttctccccagctgctttccttgagtttgcatgatatgctttggctgctatgtggagctgtcaaaagccttgaacagacaaaataaagaagaatggcattccaggaaataaacaagcttaatctcagttggacagaaggaggtacaaagaaggcctggggaaggaagaggaagaggcaggatacagggaagacagaatggactctgtaacctcaggaaaaaatagcaaccttataaatacaaagatgttccctggcagacacatgtcagcacctgggttatgaaagaccagccaatgcccccccacacaggttagaatcacattcatcaggaaggaagagagcagaaggaccctgctgcctggtgatgtctcagctggcgtggctgcagctttgcttccagcagccggggaaccgccatgggaaggcgtttcctcaaaatgcatgaaaggcggaggagcttggttttctgatggtttgctgccccttgaagttggcaacaccatcccttcatctgcatggataaaccggggcatcctttttgagaagcagtacttttttttttaagactttattaatcccacacgtttgagagaggtggttgggaaagcaagtattaatgaattaactgcttcctaggattcaatcagtcattaaaaatgtacccgtgaaattttcttgagctgttcaattgtttatcattatccaagtggttcatactctcatgcatttattttccttccacatttacctctaagcaaattacctaattcaacatggttattattctggatatttaaaagctgtgtattgggaaatttcacatagtaatatgaatacacctgttacgcttaatcctttgtgcctaggtgtgattattagatataatttatagaaattctgccgaactcattgtaatttattatccatttatggttttacttgattagtcttacttaaggatgatattttctaaatgtataaataaatgatacagcctattaaagtggaggttatataataagtgacgggtttaggagtggacatgtgaccgagctctggccaatgagttgcaaggggtatttttggaggcatctgagaaatgtttacttgctcttaaaaaagaagattgtaggaaaaaaagaaggaaaactttcctgttctactggacccccataccagacatctgcatgtactgcctcaagcaggggcaactgtctcatgactgagtagagctaagccaccacatcaacacatcgaaactggcagaggggaaagctggaaagattctaggtccttgaatttgtgaggctgctgaaccagctaaccctgcggcaaccccgctctggacttgccatttgacgtaataacttccttcgttattgaaacttgtgtgaattggtttgtatcacttgcagccaaaagccaccccaaagcttcccagctgacatctgtagactagggagtcccaacaagaggaacagacttcacctggtgaagccgtgccaacccactccacctgtctctgagatctatagacatttgaatgtgagcgtgaaatgctgctcaagttcaggtagactacagctcaagaatgtgagactacaggttggtagtctgcctccctctctaaggcaaagagatatttcaatgttacctgggacctgagaaagggggagggtctatggtttgcccagataactaaagtctgtaggttagaaagtcaggatttgtttggaagctataaagatgtatcctcatatgtcatggacatcatgtgatatggtttggctgtgttcccacccaaatctcatcttagctcccataattcccacatgttgtgggagggaccccacgggagataactgaatcatggggaaggtttcccccatactgttctcatgctgatgagtaagtctcacgagatctgatggtttcataaggggaaactcctttcagctggttctcattctctcttgtctgctgccatgtaagacgtgccctttgccttctgccatgactgtggggcctccccagccacgtgaaactgtgagtccattaaacctctttttctttataaattacccagtcttgggtatgtctttatcagcagcacaaaaacagactaatacatcatcctaacttgaatgatgcctgtcctcagtgagtggtccattgtgagtatccatcaaggagttttctcccactgcacactggacctcaggagttaccacaagctccctagcactcttcaaattgttcctcgtttccagcaagtcatctcttctccacccacctcatgaattcaatattttagatgcctgtcacattgcctgtcgctgatccctgactcttgagaccccactatgtgctacagtcttggtcccctgtttgcttggaagaagacaggaagttttaacccgaggctgtagagggcttcaggcataccggtctgttcttgttgcctggactcctccagcacatccaagtctgccctttaaccgtttcttggctacaactggtctcaatatggtgatggccaggggacagatgagctttgaaagcctcgggccaaccagccagatgttctcttgcctccagtggtcactggtgatgcctggtatgggggtgtgtccagaggttgacccactgttgctccccatggcctatgatagagggccatgctcacacagggagctgggaccaaagaccagagtccagcaagaatctctggaccaaaggtcaggcagtctggagacagtctgcatctctggcagaccccagggtgagaagcagctatcccaggccagagtggggtcagctggccaatctgggggctctggagcagatgagagggagcctgtcctgcacacttgaaagagaagttgcaaggtagtaccaaggacaattcagctctacttgattctgaaaagactatccccaccctcaccataaggagaagagacagtgtagtttgccagtgcaactgcggagggaaaacaatcccaccctatctgcctctatctcttcttctttttttttggagacagagtcttgctctgtcacccaggctagagtgcaatggtgtgagcatagctcactgtaaccttgaacttctgggctcaagtgattctcctgtctcagcctttccagtagctgggattacaggcataagccatcatgcctggccccatctctatcaatccaccatggcctgggggggattttagctatcatagcctgcagctgggcccaaaccagcgctggggaaactccacacccaccaaaacaatgcagcacagcaaactcatgtgccccctaagagggacagtggtttgaaggaaggagacagccaaattctagaacagatggctactacagagcagaactaatgacagatacagaaatagactatataatataaacaatgagaattcataaggagatattattagagcacaaaaaatgctgccagaacagaaaaatgcttgattttttttattgttttgttgttcctggatcctaagagaaactccaaatgctcaactttttccatttaaaaatttagtagaggtactgtataaaagaacggtccccactaaaaaccaaattactattttaggaagataaaatgaaagacgtatcccacagcacaagataaaaagttaatgaactaagaatcacgagttaaggatcaagatatggagggtggatgcaggaggatgcatcctatgtaaataataggagttgagggagaaaacaaaagtatgagagaataaaaaaagaaatgccaaagaaacaaaaccaatcgagtcttaagattgaaagggttctgaaaatgctgaatttagacacatccttacaaagctgctgaatttccagaatagggaggaaaatcatataagcttccagacaggaagaacacattgcttttagaaataaccagtctaggggccgggcgcggtggctcatgcctgtaatcccagcactttgggaggctgaggtgggcagatcacttgaggtcaggagttccagaccagcctggccaacatggtgaaacccatctctactaaaaatacaaaaattagtgaggtgtggtggtgcaggcctgtaatcccagctactcaggaggatgaggcaggagaatcgcttgaacccaggaggcagaggttgcagtgagtaaagattgcaccactgcactccagcctgggtgacagagagagactccatctcaaaaaaaaaaaaaaaaaccaaaaataaataaccagtctaatatcacatttctcacctgcaatcatggaaagtaatagatcatgggctaacatttagtggctagggagaagaaagaactgatgaggaatcctccaccaggcaactacagagaaatcaatgattggacctgcagtcaggaaacacagcttctctgcatactctctgtgaatactccaggatacgctaccaaagagccagatcagaacaagggtccaagggagaagacagagtgcagtgatcaacagtgagagtgaatctcgtaatatttatttttaaatcttcatgcacaatggtaacgtcaatgcaagttataacacaatttttcttgaggattcttgaaatgaaataatgaaaattttagttagatcctagccccaatctcagcatactccaggaataaggagaagacaagggcgaaggagtgaaaagaaacatgattcccagggtttctcctccaggtgggatgagatgaagaggacactgaaaatattcaggcagaagggtgtgctggtaattaagctacgttttctcaatttcaaatccactgctccctgacgctggagtgggggctctttaagctgtggttttcttttgttagatggtgttctattgggttcttccagtaagaggcaatggagggagcctgaaaagtggggagaggagatgaacttgcttcttccttttctcttgctctccatgtcagtaccagcctggcagtacccctgccctgggcttcaacctctctcaggacttccaaaccagctttcttgtgctctctcagaagtatgaacaatagcaaagcacttccctgcagatatgaaaaagactgaaagagaatactatatacagcctttcccaaaacatttgaaaaacagagaaagtgggcaaattcctagaaaaacacaaccaagaaaaactgatgcaagaagaatcacaaagtttgaataattctaggagcttctgaatctggaattccaaacttcccttcccagaaaacttcaggccaagatgacttcactagtaaattccactgaacatttgaagaagaaataacaccagccttaaataaatgtttccagaaaagcaaaagagggactaatccccattgtgtcttatgaaggaagtttaacctccatataaaatctgtcaaggacattttgaaaaatgaagatgaaagaccaatctctctcatgaatatacgataaaaaaatcccaaacaaaacattaacaaacagaatcaagagattcagcttgagcaagctgagttcagtcaaggaaataaggttggttcaacattcaaaaaccaatcaagataattcaccatattaacagaataagggagttctctcatatggtcttcccccaaaaaagaaaagtcatatgataaaattcagcatttattcatgattttttttaaactaacaaaacaaaatttagcaggctagaaatagaaaggaacttaaacaatcactacaacaacttccattaaacatcatatgtaaaataatgagaatgttgcctcaaagataagaaataacaaagaaagctgccatcatcacttcatcattttactggaagtctcagtcagtgcaatcagaaaaaagaaataaaagttacaagattggggaaaaaccccaagttatcttattttcaaatgatgtgattctacatgcagaaaattcaaaagaatgtaaagataagttaatagactcactgaatttatcaaagtagctcgatataaggttaatagacatacatcagctttatttctattttccaataacaaaatagaatgaaaataacagcatatgtggtacattttcccaaagatggatgcaacgcaatctcccccctacatgcccttttgtaccaaaatgtgggtggctgaaccttccatcaagggacagggactatctgtccaccctctcaaatgtgaactccttttgtggcctgctttgaacaatggaatgcggcggtagtgacactgtctgagtcctggagccccggcctcggaggctgacacctctacttctgtcctctggccacggtccccactgtagtgctctccttgcacggacagagctcagcccatgccactgactagggatgacaggaaaggctcagcagccagcatcaaagttccaaatagaagagtgaggccgtttagaccattatgtaattgagtgtcctgtttttaaaaagtatttcttctttctccttcctgcctgttccttgtcttgcccttagcatgagataatagtctttgctctccctccttctaccaggaactccctggcacaatgtttccctcatctaattatgtttttgtttagaagttccagagactaaatcttgaaacaattcgggccactatgggattctccctgacctgcagattacttccaagctgcagttaatttgcaactgggctgtacccaagatggcaccagcccattcaccagatggggcaataacgcaagatagtcataggaacaagtcatgtagactggcacctcctcatcactcctgcatgcccctcataccaaacaccctttttaagcccttaaccttgacccaaaaagctgaaatggtttctttcaggcactatccgcggccatttccccatggaatggggaagaaagcttttgggataaagtcactttcctttcactgtattgcatccttgttctcggctttgcaagcagcaaatagccgtgcctgcattcggttacaattggattgctccagctacactgcaatcacagaagaaagtttaggcaagaccagcaaaaaaaaaaaaaagaaaaaaaaaaaaagaaaacccatggaatcctgaggaatgataaaactattgttgttttaagccattaccttttgaggtggcttgtggcacagcaatagataaccaaaacaccatactcaatcacaataccacacacacatttattttgtttaaagtagaaatatatctaatgagagatatgcagtgcctctactcagaacattataaaacaatattgagataaattacgtgagacccaaatacatgttcatagcagacatgctacggtaaagatatcaatattccccatattcatcaaaagcttcaatataatcccattaaaaattccagcagggtttctttatacaatttgaccaatttactaaaaagctcatgtgaaaatgcaaatggccctgaatagcaaaacaagtctgaacaacaaaatgctgatgttatagataccaagtcttatttataaatctatagttattaagacaatctggtattaatgcaagtatagacaaaaagaccaacaagatcgaacagagaatccagaaagtgacccacggttaggaggacactcattcgtcacagagatggcactgcacagctgtggggaagggactgtcttttgaataaatagcccaggatcaattggatattcatacagaaaaatgaaattacattttttaaacaaaaatttactttcggtaaactgtagttctaaatataggtgggaaaataaagctatttgatgataacaggagaaaaactctgtgaccctgaggtaggaaaaatattttttaaatcaagacaccaaaaagaccactgaaaaggcaagcctctgaaagcaagaaacacatactgttctgtatgcatatttgtatacgtgcgtgtgtgcatatacagtcatgtgccacacaatgctgttttaggcaagtctgggccacgtatgtcacagtggtctcgtttgactgtaacgcccagcacagtgctcctgctcctgtttccccatcatcaccaacacctggtgttgtcagggcctctacactggctgttctctctgcctggaaagttcttcccacatggctcactcccttgcctccttcaggtccccagcaatggtgagatcttccctcataactctatattaagtgtagtaattaacggtacaatatttctactgtaccttttctgtgtttaggtatgtttagaagcacatatgctcaccactgtgttacagtcacctatagtattcagcacagtaacgtgctgtacaggtttatggtccaggagcaatgggctgtaccctatagcctataggtgtgtagtaagctgtaccctcatctaggcttgagtaagtactctctatgatgtctacacaacatgcatttcccagaacacctttgtcattaagcacataacacataactatatatgtacatgtgtatgtatgtacatacatatatgtatatatccgcccaacaaatcacaaataactcaatgacgggatcatttccagaacatacaaaataaataagaaaaatgggcggggtgcagaggctcacgcctgtaattccagaactttggaaggctgtgggcagattgcttaagctcaggagttagagaccagcctgggcaacgtggcaaaaccctgtctctacaaaaaattagaagaaattagctgggtgtggtggtgtatgcctgcagtcccagctactctgaaggctgaggtgggaggattgcttgagcctaggaggcagaggttgcagcgagccaagatcacgccactgcactccagcctgggtgacagagggagaccctgtctcaaaaaaaaaaaaaagaaaaagaaaagaaaaatgcacataacacaatggaacataagggcttcaagaaaaagagcatctaaatgtcaagtaagcatgaaaaggcactctaccttattagcaatcaaggagatgcagaacaaaactgtaatgagacaccatgactcaccaccctatggctaagatgaaaatgactgacaacatcaagtgcgggtgataatggggaaaaacaggaacattggtggggtaatgtaagctggaccaaccactgtggaaaatgatctggcattatctactaaagttgaacctatgcaccccgaaatttcactcctagagagtgcacaaaaagatttgatatgaggcacggtgtggtggctcacgtctgtaatcccagcactttgggaggccgaggtgggtggatcacctggggtcaggagtttgagaccagcctgatcaacatggcaaaaccccatctctactaaaaatacaaaaattagccaggcatggtggtgcgcacctgtaaacccagctactcaggaggctgaggcaggagaatcactggaatccgggaggtggaggtttcagtgagccaagatcgcaccactgcactccagcctgggtgacagagtgagactccatctcaaaaaatatatatatacatatataagtgaaagttcacagcagcattatttgtaatagtcaccaaattgaaataatctaaatgtccatcaacaacaaaatgcataaataaaatgcaggatgtatacgacgaaacactgtacagcaataagaaggaggaactacggctaaatgcggcaacatgaatggatctcattccttcactgcttttgtggatctggccctggcctcccagggcacaggtaccagagggaccctcctgcaagtccctcctcacctcaccaccacaatggtcctcaaaaaagtcaaactctttaaaatcccccaccagtctgcacaccgggcagcccctgttgtctagcctcacctcctactttccctgagggcactctcccgagccataacttctcctcgcagtctgttccttgagtgtgccaggcgtgcttccacctcagggctctgcacgggttgtcctctctgcctggaaagttcttcccctgcagaatcacgcggctcactcccttgcctcctgcaggtcttggggaccatgagccctttcccatgactctatattcaggtatcaccccatgtccatactcccgaggttttgaacgagttttactttttcaccataacactcacctgcatctggtatatgatttatctgcccattctgtatgatcaatctccctgcacaagaatgcagctttgggagaatgagaattttgcctcttttgttcactgttatatccgtaggagccagagctcttctaacacacagaaggcgctcagtacaattctgttaaaagaatggccacataagaagacagaaacacaaatgctgactgatgctgtctgtgcttagacagagcttgtctatccgtgggcctcaccagtaggttcctctgcctgtgatttcctttctctaggccgtgaacttctatagaaaggactcttgcagctcctgccagggcattgttgagactagcagccagcactgtgggagccaaagggagtgaagctgaggaggccgatggagatgcggcctcatctcttcaaaggctctcacttaatcccaagtgacttaatcccagtgttcacagaacatccatgtgcccccctgcagttcctgcctcccttgcagctgggatgggccatgtgcctgagtctggtgaatggacatgtgagtagaaggggtgtgtcccctctggcctgaggtgctcaccatcaggtgcctcccccatccctttcttccccctagacagcaattctgggggccatggaaggggtctcattacctcccttcccacacagaggaaagctgccctgaagagctatccagtccatactatgcatttgtgactaagaaacaaacctttgctacgttaagccattgaaatttcaagggtttttttgttactgcagcatagactatctcatcctgacgatcttctgtcaggcacccccactcctgccttagctgtactagacatccttgtactctgatgtctctctggttcaacctctgtctgctactggggtcagatggacagttacaaagctgcacaggctccatttggggctctgagggggttgcctgcatatcacagactgtaaaccagtgctccttttgccccatccacattcctgccttcagagacatctggtgactctaattcctgagcccttgcagggccctgaggcacaaatcagcttgtttcttcctgccccaccctggacccccagctctcagcatggtggataagcagaaagaaatcgaagccaaccacacaatgatacacttctcgtgcttccaaaatgctgctgacattttccatctgttcatctcctctttgtgagtttgaatcttttttcttttattcttttattgtcattttaatggtgcttcaggagaaatagtgataaacaataactatttcgtgaatacctatttattttgaatattcattgtaaccactgctaagaacagcaaaacttttaggtttgcataggttttttttttcttccaagaagttcagagtacatttaaaatatcagttcaaagaacaaaaggaaaatattattattaccattttaaatcagataaagccctgtgaggtctgaaaaactgccccaccacccaatgtttgccaatgctgggacacaatccaggctcccatctcatgatctgattttctactagtggacactatcctgagtgctatcatttatatccatcttcccacctttcataggaattctatctgcataacccaaagaatacctgctggagactgacacttactgcaactttgccagcactttcatgttcttaacaaggcatttcaccagtttaactactgatcatcactgacaggcttcagtacataatttcatatatgaatcttcatccatctttttcttttcttttctttctctcttcctttctttccttctttttctctttcttcagtacataatttcatatatgaatctccttccttctttccttccttccttccttctttctttctttccttctttctttcttgtttttcatggagttttgctcttgttgcccaggatggagtacaatggcacggtcttagctcactgcaacctctgcctcctgggttcaggcaattctcctgcctcagcctcccgagtagctaggattacaggcacgtgccactacgcatggctaatttttgtatttttagtagagatggggtttcaccatgttgtccaggctggtcttgaactcctgacctcaggtgatctgccctgctcggcctcccaaagtgctgggattacaagcatgagccactgcgcccagcaatgcgttttcatatattccataaaacacagaagtgtgtactaagatcatgtatatgtatatggcttggaaaatttataaggtctccatctagaagctgtacatctttggttttaaaaggagagggctagagagaggataaatccaatcagttgcttctttcattcctcacttcttttctactgttaacatacgtggtcataaagaataccagatgcaggccaaatacatttgccatgagaaaaagataaaaatcaaaacttatggcttctcaatactgcttagtattaaagcacaatgctgcattctctactacagctgtgtagttacaagaatctatttgagtggccatgtgtcaaagataatggcacaaaaaggctgggtctatatggctcatggcccaacatccactgcttaacatgatgctttttctggattaagatcttcaagtcaggcaaaggctccggaggaggacagaaaaccaaagtgaagagatgcactaggtagggaggtttttgggttgtaagtgatagaaactcaactcccgttacctcaaacaaaaaggggaatttattgactctttttttttttgagacggagtctcgctctgtccccaggctggagtgcagtggcacaatctcggctcactgcaagctccacctcctgggttcacgccattctccctcagcctcctgagtagctgggactacaggcgcccgccaccatgcctggctaattttttgtattttttttttttttagtagagacagggtttcaccgttttagccaggatggtctcgatctcctgaccttgtgatccgcccgccttggcctcccaaagtgctgggattacaggcatgagccaccgcgcccggccaaatttattgactcttagaaccaggaagggttcccccaggtcccaggcagagagtggggatgcaagcaggcccagaagcaggtgtgagctgctgtgggcatcgctctgtccaggccgtcccctctgtccttggcttggctctaatcctgcagcatggcttacttcacactcggggaagcgtggaagttggccatgctgagcaactctcttaatggagagatggagtgtggggtccacaccctccacccccgctccactgcctgcacaccatgccaagtccaggtattctagggaatggaattctttggggttcgctgccatgcccaagacagtgccttcatgctgtcctcacagcgcatcctgcagtaactgtggggaaactgagggtggggggagattgtctgggaagaggagctgggcctacaattctgatgctccctgcagcctaacctccaccccccatgtcactgccaaggaatcttgcagcccagagcagacagcaagagcctctgcccactaggtctggtgctcagaagcaaagagggccctctggggggacagtcaacacaaggagacttagggtgggtatgggcagccagagccccagccccaggagctgggattagggcccaggaatgaggaaacagggaggggaaagcacattgaccaatcctggaagcagcgttattgaaaggttctggaaattcaaagaagcaggcaatgtgtgggcagactcccgttagtggccagagcccagaaggaaccaactttgccttcaacctcagcccactccctgctaacagagggagatggtgacgagtctgaggggcagaaggaggtccaggcatagaattgcacttgtcctgggtctctgcaggtcagcagtgggatgagtagggagacagcccgccctgggcctccacagtggggaaatgaggcaaacgtgtctcttttgctacaggaccaagtccactgtcctagaaaggtttagttgacaaaaaaggagacattcacacatttcctccagcagacccactcactgttatttgttacctgggaaaccaaacagccatatataaacaagggtaaatcttagaatcttggaaatgaaagtgccataatttccaggatgatattaaaacgccgtgactttctgaaaagggttccagcaacgtggttgacagaaaatattgtgctttcttttccacaaggagattgaatgtgtcttatttacagttacccagaaaacaatgatgaaagtagctaagtctgcattctagaggcacaggtcaaggtgtctgaggaacaatttggcatcttggaaagtgaagtcccgaggctgggaccctgtggggagccttcttcattgcaggctccaagccgccagtctcctgctgtagggagaaggctgtcggtgctgcaaggatggagggggatgtgcagagcccaggcactgagagaagcttcttagagccagaccatcgggagggagaaaacagggtgacaggggtcagttcatgaagacccttggattggatttcattccaagaacagtgaaaaacccatgtaaatcaggacttcgtgaatgtgcttattctaacttccagaggaaataatgaatgaactgtctactgaaaacccctgcctgtgctccatctgaaatgctgcctccctcaaagcatgaagctggagtcagcactgacgacgatgggcagctggagtgggagaagaggagtggcatggcctcagggagggccaggtccccctgcacctctttcccacttggtgtcccccacctggtcactcccaggaagccactgctgaattgacagccaggcctctactgagtcaagggcgacatctggagatgtagaatcagacataaaactcagcacagtactcatcccttatccttagggggatacatcctaagacccccagtggatacgtgaaactgcagatggtaccaaaccctacgcagcagtttttcctatacttacatacatatgatacagtttataaattaagcaaataagagaataacaatagctattgataaaacagaacaattataacaatatgccagtaaaactactcttgtgttttgccaccattaagtaatatgagggttccttgaacggaagcactgcgatgtatgtctgataaccatcctggctactaagtgacggccacgtggggagtgtggacagcctggagacgctggacaaagggatgaagaaagacagcaggagatttttatcctgcgactcagaacagtggatttaaaacttgtgagttgtctgtttctggaatattccatttagtatttgcagcccatggttgatcaaaggtaacagaaactgtggaaagtgaaaccttggggaagaggggactgctgtataaaaaactttgaaaccttttccatatgtgtgtgggctccatccaatcacgtgaaggcctcaagggaacaagactgacctcccctgagcaaggaggaattctgccagcagaagggctttggatcgaactgtaactcttccctgggtctccagtctgctggcctaccctgcaggtttccacaacaccatgagccaattcctgaaaacaatctctctctatgtatatatacacatcctgctgattctatttctctagagaatcccaattaatagaaacagtaatgtagaaaagagatgatggtggcttggatgagggggtagcagtggaggtgatgagaaatagttacattcagggtgatttgtaggatttcctgaaagtttggattataggattgagagaaacagaagggctaagaatgaatctacagaagggcaaatgtaagatgctatagaaggcagaattagacctattttaaaaaacacatgaaatcctcagaacaaatattggaaaaagagatcctttaaaaaattgttacaaaactacaaaataactaggcccaaaatcgacagaaaatattatgaacctaaagcaaagtaaaaactctgaaactctacagaaaatcataaaacttgatgttttttaaattaaacattacatatattgaatactataaagatgtcagttctactaaaataacatataaatccagtaatcctagttacagtaacaactggattgggatatgtattagttttctagggctgctgtaatcaagtaccacaaattgggtggtttaaaacaacagagcatccatcagggagagaattggtcaaatcagagctttctagaaaggccatcccttaagagcaggtctatctcagctctagagtaagggttactctaggccattggttggcaaactgtagcacatgggtcaaatgtggcctattgccctgttatcatatagcctgtgaactaagaatgacttttacattttaatgaagaaatatatgtcacagaccatctgtgacccataaaccctggtcctttacagtaagtttaccaacccctgctggaaacctaccataaaaaatcttaaaaacaaactcaaaagcaccaagctaatccacaaataaatgaactaactacctgccagaacaaaattcaacactctctgaagcgaacaaaatctaaaatccagacactcagccgtatcacatttacaatgtccagcatacgctcaaaacttaatagatgaattcactagagaataagtttcagacaaccaaaatgaccaaagagacactgacaaaagacatatggaaagctcacactggccaaacttagaacagtgtacgcatcatagggaataataattgcagggagtaaaacatgtctatgaagttcataatgatctttacaaaaacaccatttggccacttctagaggatgctcaaaaaccaatgtattctcctgatgacagataaagggaaataacaaagcacagtagataactagtaccatctctatatcaaataatcaaactaataaatgatgaggaaattgtagaattagaatatcatcagtttgcaaccttcagtgtattaatgaatccaggcatcacacattaaaagttgctaaaatcacagagaacaccagactttggcatgcctctttatgaatgaacagaatcccacctatcatcttaccaaagagaaagaactggagtctgatcaggcctctaaatcctgttgcttattaacaggaaatatacagaacacaggaacattttgaactgcagcaaaagtaggtaatcagtgaatccatgcggggtctacaggtgaaatgcttcggctcttgaacagctagactataaggaaaaatgacccattaagataaaaggagacaaaaagactttaaaaaaatccaacaaaacaaaactaaactgcagtgtctgaaggatgcacatttagtgttgaaacaataaaagaatctagcagctgaatgcacatggtttttaaacttgtggaacatggacaaaaattgaccacacatggggcagaaaagcaagcttcaacaaatgtcaaaagtttgaaacagaaaatgtatggtttctgacaaccgtataattaagctaggactatataacaaaaagatactagaaaacctatgttcacaaattaatatccttctaagtaacctatgaatcaaagaagaaataatcaatattagaaaataatttgaacggaatgatattaaaactaataggatacaagtcaagctgtgtttagagggaatttatagccctgagagcatttattagagaagtaaagctgaaaattaatgacctaagcattcatctcaagaatttagaaaaagaactgcaaattaaatcttcagaaaagagaaaaaaaaggaataataaagacagaaagcaatgaaataaaatttcaaaatacaataaaaagggaaaaacaattcattgataattaataaaactggcaaatctgaggtaagattgatgaagaaagcaaactgcaggcatagataactactatcagaaatggaaaggaggtatcacttctcctacaggcattagaaagctaataagaggatattatcaacaaatttataggaatacatttgaaaatttagataaaatggaggattgcttagaaaaatacaacccaccaaaactgacacaagaagaagaaatactgaatttgaatatattgtaactattaaagaaactgaatcataattcagcaccttccatgaaataaaatcctacagccagatgacttcaacagtgaattaattctaatgaccatttaaggaagagatactaccagtcttacatgaactcttccagaaaatagaaaaagaactattcactgtgttttctaaaggcagcataatcttagtaccaacctctgataagacctttcatgaaggaaaatgatatgaaccatctctctcatgaacataaatgcaaagatcctaaacaaaactttaacaaacgtgacttgaaagtgaaaaaaagaaaaaagaagagtaatgtccatggaaataaactagaagtacataaaaatgataacacaccatgaccacataaggttggatccaggaagcttggtctatccataacaggttgaagaaatattttatgattatgtgacagatgaagaaaattacagaactgtgttcaacaagtattcatgttaaaaaaactcttagcatacttggtttaggagttttggctacagcttactggtgtttaacaaactccttcggcctcagcagctgaaaaccactttcctatggtcatgaggtctgtgggtcaggaattctccaggcacagtggagatggcttgtgtctgctccatgatgtctgggcctctgctggaaagacgcagtggtggagatgaactgctgcctcttcagcgtcaccttttacctaccactcagccccaggtcacgtggctgcagcacactggcttcttgactgttccttcaactcaccagccaggctccagcatcacagaccttacttgctcttccttctgtctggggccttcttaactagacatccacctggctggacattcttctttctcaagtcacttctcagtgggatttctctggcctccctatgaaaaatcaaaatccccatcctgtgcccactgaccctctctggccccctttctgcctgtaattatcactttataatatataatatagttaacttatttaactatacttttattctatgtcttccctcatgaggatgtaagcttcatgaggcaggtatattttgtctaattttattcattgctgtatccccagagcctagtatataataaagcacacaaacattagctgttgattaaatggatgggtaggtagatggatgagtaggtgggggatggatggatggatgaatggatgggtggatgggtaggtgaatggatgagtaggtgggtgggtgggtagatggatgggtgggtggatgaatggatggatggatggctaggtgggtgggtggatggatggatgtgtggatggatgtatgggtgaatgggtagatagatggatagatgaatgggtaggtgggtggacagatggatgggtaaatgaatggatgggtgggtgagtggataaatggatgaatgggtaggtgagtaaatggatggataatggatggatggatggatggatggatggatggatggatgggtaggtaggtgggtgggtgggtgtacagatggataagtggatggagaaatggatggatggatggatggacggatgaatgggtagacagatgaatcggtaggtgggtagatggatggatggatggatggatggatggatggatgatggatggatgggtgggagggtgggtaaatgcatggatggatggatggatagatagatggataaatggatggatggatggatggatggatggatggatgagtggatgggatggatggatgttgaggcatggcatcaccaatggtagataatcactgggttaaaatggaatatatgttgctattaggaagaatgaattaaaactctatgtgttgttatgaacaattaccaagatttattatgagaaggaagcgaggtacagaacatagtcttttttttcttttgagatggagtctcgctctgtcagccaggccggagtgcagtggtgcgatctcggctcactgcaacctccacctcccgggttcacaccattctcctgcctcagcctcccgagtagctgggactacaggcacctgccaccatgcccggctaattttttgtatttttagtagagacggggtttcaccatgttagccagacagtctcgatctcttgacctcgtgatctgcctgcctgggcctcccaaagtgctgggattacaggcatgagccactgtgcccgaacagaacatagtcttaatatgctccttttatttccatttaaaaaataatttctatacaggtaaatatgtgtggatatgcatcatcagtgttttctgaaagaagtaaaaaacactattcataatggaagttctagggagaaggactgaaatacaggtgggaaggatgccttacttttccatttagcacttttctgcaaagtttggattttctaaccatgctactcatatttttattttaaaatatcaacaggagttttttgacagtatgatcatggactatttaaaacagtttttctttacaattcttgctacctaaaataatacttgttataaaataaaaaataagggtaattttatttaacagaatcgagaaaagcaatgctagtttttaaggacttccttgaatcactgagaggtcttcttttgtcacataaggattagataatgttcaatattttctatctgctaaggcagaagtacttttacttatgcatgtccttagagttttcagtaacaaaaatttcagataatcagagcactttgttctctacaccgtctgcttttctgtgattttacggtaataggcagtataacagagttgacagaaaaacacttagtaaataaatatggtttaaaactttttatactaagttttatgtctgattctgtgtctccagatactacctttgactaaggagaggcatggttgtacgttcaatgatggctccctgggaatgacccaatggaagtagcattttggaaaccctggttctgtaatctgaacgttgtggcccatgagattaacatatagaaacctaattcccagtgtgatagtattaagaggtgaggtctttggaaagtgattaaatcatgagggcgtaaccttaatgaatggaattagtgtccttataaaagaggctccagagaacttcccagccccttccaccatgtgaggacacagcgaggaggtaccatctatgaagcagaaggtgagcccttgccagacaccaaatctgcttgtgccttcatgttggacttctaaccctcctgaactgtgagcaataaatgtctatggtttgtaagttacccagcctatggtattttgttatagcagcctgaacaaactaagacacccggggtctttgtttgttaactatgcatattgaagctctaaacccatgcccatttccctgtttttttcatttttgatgtttgctcagtttgtggcccattttcactcttcatcttcatattgcaaatatctgatatgacagtcgagtggaagcttctcttccaataagaccatgtaacaaaaatggaaaaccaaaactattctgaaaaaagccatttaaaaaatgcataccaagattttaaaaaaattcctgttaaatttatcatgagtccaagctgttcattcaacttatcgtcttggtatttgatacaaaaaatccccattcactgactttttaaaaagtagaatgatgctggtgagttaaggaggtatagagtcccatgttttaaaggaagatgcagctcactcacactgcagcaatatcctttgccggctgaagcaaaataaaaatcagttctactgaaagttgataaagtttaagtccattaacagcgagagtactttatattagatttgcaaatgaatgagaaattaatggagaaaagagctctcacaatagcttcaaaatgggcatatttataaccctattctgcttgccaaaaataattacatcccatttttttctgccaaccatttaaactcatttcatagaaaacggaaaaagagggttggtgcaaatgggatgtttcccgcaagaaagaagaacggttttggaacccttgagcaatttgcaaggcgtgtcaattttggaacgctctgtcttgaaatattcgctttttttatgtttatttgtttacctattgtttattctccaaatcaattacacaacatttatttccaaatgccacaataatggaagactggcatcacatttggaattgattctaatgctgcacagccgcctgctgaggatcctgatccggttcatgagctgaggctgatcccagcgaccccagacctgaccaactctgcattacccagggaggagcaggccagtctgagcagactcaaaggggccgcttctactcggagccactttgcatccactccaccctaagcttctaagatacttcggagcccacacgacactccttcacaggggctgggtggcctggcctgccacttgaaatatggggctgctggcacctgctgtatccttctcagccccaggcatagctgctgaaaaggtgacaggaagagtctattttcatgtcatcacttagtttgtatttgtttgcagctatttcagccttttacatttgtattatgcattctgaacaagttgctatttgttttcttagttgatgtagtcagctgcacagaaatgcttaatgcttttctcagatgattccaaccaaactgactttgatttcagacagatagcccatggccatgctgacacataaaaccaaccatgacactgggttttttttcagccttttattttttttttaggtttagggacacatgttataggggtactttttttaggtttaggggtacactgtcatagagctaaatggcatgttgttgggggttgttgtgcaggttattttgtcacccaggtgattaagcacagtacccgacaggtagtgttttgatcctaacccccctcccccaccctccaccctgaagtaggccccagtgtctattactcccttctttgtgtccatgtgtacccaatgtttagctcccatttataagtgagaacatgtggtatttggttttctgttcttgcattaatttgcttaggataatggcctccagttccatctatgttgctgcaaaggacatgatctcattctttcttacggctgcatagtattccatggtttatatgtaccacattttctttcttttttctttatttttgagatggagtctcactctgtcacccaggccggaatgcagtggcgtgatctcggctcactgcaacctccacctcccaggttcaggcgattctcttgcctcagcctcccaagtagctgggactacagacagctgccaccatgccctgctaatttttgtgtatttttagtagagatggggtttcaccatgttggctaggctcatcttgaacctctgacctcgggtgatctgcctgctttggcctcccaaagtgctgggattacaggtgtgagccaccgcacccggctgtatggcattttctttatcaacactccactgaaaatattgaacagatcatcgaggcagaaaactaacaaagatatttgggacctgaacttgacacctgaccaaatggacctaacagacatctacagaactctccacccaaaattaagagaatgtacattcttctcatctgcacatggcacatactctaaaactgaccacacaatcagccatgaaacaattctcaacaaatgcaaaaaaactgaaatcatagccaccacactatcagaccacagtgcaataaaaatagaaattaacactaagaaaatcactcaaaaccatacgactacatggcaaacaaccatgacactgttacagccatcttacctgttccctccttcaagacctcccttgcagcctgctctcaactcaccaaccagagtgggcctttaaaaaattaagccaggcaatgacactctctgcttaacacctcccagtggctccctacagcacacagagtaaaaggcagaggacttagattgacttacaaggccctgcagtttccttccctctcccttcctctatgatcccctctctttcctccccactgctcacttccctctagccacagggcctcctggttgctcttagaactgtcagtcccactcagggcctccgtactgactattccctctgcctcagacattgcaaggcaaactccttcacctcctcactccctcacttggctcaagagtcacatgctcaatcagctctgctgtcaccatcctatttacaatgatagtttctgcccccatcactccctcagccaactgtaccacgttctactttctaacagacgttaccatttttagtctattactatatgccttcattaggatgtgagctccatgagggctgagatcttggtctgatttgttccctgatctatctcaaatcctcaaaacagtgttaatagttgaaaagcactcaataaatattggttgaatgaacaaataaagggcttatcaaatgcaaagataaatttttcatttaaattctctgccagaatttctggttccagaagatgggcagaggacaagtcatactggagcttgcacggcacaatgagttcagaagactattctgagtgagactggaagacaaatgagaattttgaactggggagtgacatgaggtgacttacaggtttttaaaagttcatcatggcttctgtgtggtgcacaggattcaaaggcaggagtagcgccagggagagtatttcagctgccttggtccagcaagagattaaagtggttcagaccagagaagctgtgctggaggtgatgagaagtggctggaccctggatatactacgaaggcagagctaacaggtcttgttgatgcactttgctgagagggagaggaagagagggagtggcgagagtcaagggtaactgttgaagttttggcctcagaaactgagtaaatggcagtatccattactgggacagaacagaggggagaagaacagacttgggagtggaatcaagaattctgctttggatgtgttaaaatggaaatgcctaccagacatccatatggaggtgctgactggccagttggatacatgagtctggagcccaaaaaagaagctgaactaaagatagtttttaaagccatgggtctggttgaaatcccattagagagagaagctggatagagaggaagactcggggcttcgtgctgaagcacttcccctttaggaagaaaagccagcaagaggggctaaagaagcagccagtgaggtagggaagggctgagcagctctaccgaactggaagccacatggagcatgtgtttcaaatgttgctgtggggtcaggtgagaagagtctaatcactgactgcgggatttggccatatgagggccttggggccccaggcagcgctgcgataccccagtgggttgttggtgatccttcaggatgggaagcagtgcccactggggcaagtagggtggtacaggctgactgtgggaggcgcagggctcagggaaacctgagcattcagcatagacaggaacctggagtcaggatgacaaggaaaatctcctgaattgggcacaaggatccttgggggggatgaggaagaggaattgagcatgctgcatttcctaaatgtggggcattggggtgcaaggcggtgcacctgaatatgaaaggaaatagccatcctataattccagaagcttgaagacaccaagagagttacactcacagagaagaaaaaggtttgcttttctcatggaaaaggttatatgtaacaagtttaggataccacatgacaatgtcttagttttaattaacttttataattcagcacatttttaaaagcacatacttgtatttctgataatgctatgccaggtttttacacttgtttcatattttttctcaagaggaagttatagtagtgtatctaagatatactgaaaaataattggtaattttttttttttttttttttttttttttttttttttttttttggagatagagtcttgctctgccacccaggctgcagtgcagtggtgtgatcacccaggctggagtgcagtggcgtgattacccaggctggagtgcagtggcgcgatctcagctcactgcaacttccgcctacctggttcaagtggttctccaacctcagcctcctgagtagctgggactacaggcgcatgccaccatgcctgactaattttttgtacattttagtagagacagggtttcgccatgttgcccaggctggtctcaatctcctgagatcaggcaatccaccctcctcggcctcccaaaatgctgggattacaggagtgagccactgcacccagctggcaaatattcttttttatttttaagttcatttgccaagaactcaattatttatagtggtacttctctctagctttctgtaactaaatgagaacattaatttcaaatgtatctctctactaaaatcatacagggtgttctatccttccttttatacaaaaaaaattgacaattatctgacgaaataggaaaatttgaacagccatgttttaaaagctgatcatgtcatgcttcagctaacataaaaaaaaaaaacctgaagtcaaaataaacgtttaaataacctgaacatgctgataattgacattgctttctatcataatcatcactttaacactgaaagatgaagaacttgctagtggtttaaggtagatcaggcattggatacagatccttcccattggtgtttactatccaactgcaagagatattggatgaaatatgaacatagcaaaacatttaaaaaggagaaattagatttagagaaaaaactaacttacctattgctatggactaaagtgtgccctctccattcatatgttgaagccttaaccaccaatgtgactatatttagagatagggtctttagtaggtacttcaggctaactaagatcacaagggtagggtcctgacccacaaggattggtggccttagaaaagaagaaagagacagagacctctctctctctacctgcacacacatggagaaaaggctatgtaaagacacagtgggaaggcggccgtctgcaagacaggaagcaagtcctcacgagaaccagaccatgctgccactttaatcttggactttccagcctccagaactgagaaaaactaaatttttgtgtttaatccacccagtttacattattttgttatgacaccccaagatgactaaaatacctattaatgagtttttaaaaaattattttagaagagaaacaatatgttgggttgtaatgtcaacaaataagtaataatgtgtttatatatttctatgatttttctgagagagaaaaattttaaattgagtaaatttctccccctaggatgcctgtctacagattacttcttccataaactctgacctcaacaattactcctaacaggaattcgaactgtcttgatgcttgaccagcctggccaacacagtgaaaccccgtctctactaaaaatacaaaaattagccgggtgtggtggctcacgcctgtaatctcagctaatcagcaggctgaggcaggagaattgcttaagccagggaggtggaggttgcagcaagtggagatcatgccactgcactccagcctggctgacagagactctgtctgaaaaaaaagaaaaaaggaaagcgtggtgacttgttttagacactttcactactgataatgacagttcacaggaccaggcaaagcagagactcggcacagtgccacagggagaccctgtcctgggcgccgagtggacctgcccctgagtcagctgcctccccttaccagcggtgcggccctagcgctcactgcatttcctcccacccctagtttcttcctcagcaacacagggataggagctcccttgcaggtgactggaggcagtgaatggtccacatatataaagcagctgcagtggtaccttgcacataacaggaattatttttagaatgacgttgaagatgttcagaatacccaaccccaacatatggagctctggcatactgttttcagttaaagacccttgaaaaacagcagaggcaagaaggacattctaatcaccccttttcttcctgaaaataggagataaacattgccatgtgaaagatgtcctccctcaccaggagaatgaaacattcttcgatggggaggaagagccaagagaccctgtgaaatgattcttactccttcagcctccccacacagtgtacctgtccccagctgcctctctttgtccatcttggtataaaagcatttgtgttttgctacttctctgggtcttcatttccttatgagggctcctgagtcacataaaacatatataaattggtgtgctttttcctattaatctgtcttgtgtcaatttaattcacaggcccagctgaaaaccctaggagattagaggtgaaattctgtctcccctataattgaatgtattataacacaaaaatatactcagaaagaagtcattaatttgagtatagtgataatgatagctatcagagtaatcccttttaaaatagtttcagttcctgtaataccaaggcccactcacatgttgtagtattgttaccactgtcgcggtaattagtttccatgacacaaaatcacctcacttgctttcccacagaggcagcaatatgctaaaagagcagactctagaccaggtctcccggggtccaagtcaagtgtgtgttgatgaccttccctgaaccctggctttcttctctatagaaagtgctcagtgggccaagcacggtggctcacgcatgtaattccagcactttgggaggacaaggcaggtggatcacttgaggtcaggagtttgagaccagcatggccagcacggccgacatggcaaaaccccgtttctactaaaaatacaaaaaattagtcgtgtgtggtgctggcatctgtaatctcagctacttgggaggctgatgcaggagaattactcgaacccgggaggcagaggttgcagtgagctgagatcatgccactgcactccagcctgggagacagagtaagactctgtctcaaaaaaaaaaaaaaagtgctcagtggtaatgcctatcccataggacgactgtgagattttgaacaataacatatgtcatgcctgtgcttgaagcctggcatgcatggccctcaggaaatgtgtacactgacctgggcataggactgagactgtcagagggaaacacggggcctgggagtagaccctgcatgctccgagggtctgcttccatgtgacgtggactgaaggtccctctcctgattcttcatgagatgagccagacaaacatcttatgagtgtcaccagcagcaatcaagacaggaagaaaggggcatcatgtcctgtcatgaactagaaagggggggcaggacagaaataagtggagaaaaggagatcctgaaggttccatgtcctccccagccctcacctatgtgagcacaggtgagcagacagaagctgagaattcgcactaataccttcaagtctggggtgatggggtctgagttgggtgcaggtagttctaggacaattttttaaaatctctttaaaacagaagctcctacgcagcaactcaggagctcaaccaagaaagaaagggccaggactgagggacggatgacgctcactggagcagaactgccctggctcggtcaaggggacatctctagggaggtcctcagagggaagagcaagaacccaagacctagcaaggatgtgctcagcccctgggggatctccccaccctgtcctaagttagacagtcaaggccaaaggcaacatccatgtctgaaatggagcctctgacaggagaagagaaactggccctggtgggtctgaaggctgtcggggcagggaagaattgtccgggccaagcccaggagcacaaggagagtgggtacatcaaggtgcatggaagcacaccacagcttatttggcaaacagaaggtcagcagaaacagagcttgaaaatggggaaagaaacatcaacccagacgccaaagctccccacaagaacttcatggaacctaatacacacataaacttaacaaaggaaggactcaaagtgagaaaaacaagactatgatgaaaagaaagctagagacagaactaaggaaaccaattacagcgtgagaattaaaaccccatcactgcaaatctagtaaataatttagaaacagcaaggaacagagtagacatgagtgaaaattcaagataatggcatgggggaaggtgtgagatctccacagtaattttgtagaagaaggaagagacaaattacaatgaagaggacccgtaaggagattgggaatttttttttttaactctagaaacaaatgtgctttgtgatgagagacctgtaatctaaaatttagtattctctcttcagtttcatttcaattctcctgttaatttcaaacaaagacaattttttaaaacatacacattattcttccatagcttgtgtcttgtatcattatatgatcgatagatttctgaatttatgaccacataacagtctgatcgtttctggatggtatacttctgggtaattcattgcctttgctgttgtacttttctgtatttgcttaaataatttatgagagacatgcattgttttttatttttaaaagtataatcttggccagatatggtggctcacacgggtaatcccaacattttgggagggcgaggtgggcggatcacttgagatcaggagttccagcccagcctggccaacatggcgaaaccctgtctctactaaaaatacaaaaattagcagggtgtggtggtgcacatctgtaatcccagctactcaggaggctgaggcaggagagtcgctacaacctgggtggtagaggttgcagtgagctgagatcgtgccactgcactccagcctgggtgaccgagtgagactccatcccccccccaaaaaaaagtatgatctttaaagggaagaaaatccactcaacattctttcaataagtagatattacacactatattgtaggcactgggattatgagctaggccaagaccttgcccagcttccagataaagtcatggaggttatagattcaggaagacaaacattactccaaatacagttcattccagaaatgcaagagtgattcagcattagcatatagtccatcctgttaacagagctaaagagaaaaattatatgatcatctctacagatgcaccaaaggtatgtgaaaaaatcagcattcattcctatgagaaacaacaaaacagaaactgagggataggataaagtcatgcctaacaagatagaaaatacatatttatgcaacacatacctaacctcaaaagccagcatcttaattaacaaagaaaaactaacttttcctgctacagtctggaacaagacaagcactcactctttaacactgggtctgaagtattagcccatgtacttagacaagagaaatcaactgtagaaataacattcatgaaagaagaagttaaaattatctttatttgcagagcatatgtttatgtactcacatgtggaaaaacaaaagaatccccacaaaacaagcaccaaaaaaaaaaaagaaagaaaatctaataagaaagctggttgtataataaatataggcataccttgttttattgttcttcactttatcatgcttcacagatgttgagtttttttacggattgaaggtttgtggcagccctatattgagtaagtctatgagcaacatttttccaacatcatgtgcttactttgtctctgagtcatattttggtaattctcagtacatttcaaactttttcattattactatatctgatatagtggcctgtgatcagtgacccttgaagatactattataattgttttggggctccatgaactgtgcccatataaggcagtgaacttaactgagaaatgcatgtgttctgattgcttcataggctggccgttcccctgcctatctgttccctgagacacaacaatattgaaattaagccaattaataactctacaatggtctctaaatgttcaagtgaaaggaagggtcacacgtttctcattttaaatccaaagctagaagtgattaagcttagtgaggaaggcatgttaaaagacaagagcagccaaaagctaggcctcttgcaccagttagcaagttgtgaatgcaaaggaaaagttctcgaaggaaattaaaagtgctactccagtgaacacacgaatgatcaagaaaacagccttatcgctgatttggagaaactatgagtggtctaacagaagatcaaaccagacacaacattcccttaagccaaaatctgatccacagcaaggcccgaactctcttcagttcaattcaatgaggatgagagaggtgaggaagctgcagatgagaatttgaagctaacagaggttggttcctgaagtttaagaagctgaggcagcaaatgctgataacctgcaagtccagaagatccagctaagataactgatgaaggtggatacatgaaacaacagattttcagtgtagacaaaacagccttatactggaagaagatgccatctaggactttcatagctaaagagggaaagatgacgcctggcttcaaagcttcaaaggacagactgactctcttgctaggagctaatgcagctggtcacttaaagttgaagccaatactcaaccattctgaaagtcccatggcccttaagaattatgctaaatctatttcacctgtgcactagaactagcccaacaaagcctggatgacaacatatctgtttaaagcatggtttacttaatatttcaagcccactattgagacctaacgctcagaaaaaaaatatgcctttcaaagtattactgtttattgacaatacacctaagagccctgatggagatgtacaagaaggttaatgtcatttttctgccagccaatacatctactctgcagcccacgggtcagggagtaactcactttcaagtcttattatttaagaaatgcatttcacaaagctagagatgccatacatagtgatcctgtaataaatctgggtggagtaaattgacaaccttctggaaaggattcaccattctaggtgccattaagaacatttgtgattcatgggaggaggtcaaaatagctacattaacaggagtttggaagaagttgattccaatcctcacaggtgaccttgaggttttcaaaatttccgtggaggaagtaatcacagatgtggtaggaacagcaggagaattagaattagaagtggagcctaaagatgtggctaaattgttgcaatctcatgagaaaactttaatggacaagcagctgcttcttatggatgagcaaagaaagttgtttcttgagatggaatctactcttggtgaagatactgcagacattattgaaatgacaacaaagggtttagaatatgatataaacttagttcataaagcagcagcagggttagaggactgactcaaattttgaaaaaagctctactgtgggtaaaacgctatcaaacagcattgcatgctacggacaaatcttttgtaaaaggaagagccaatcaatgcagcaaacttcatcactgtcttattttcagaaattgccacagccaccccaaccttcagcaaccaccaccaattagtcagcagccatcagcatctaggcaagaccctccaccagcaaacagatgacaacttgctgaaggctcagatgactgttagcatttttgagcaataaagtatttttaatcaaggtatatgtataatttttttagacatatgctgtggcacacttaataggcaacagtataatgtaatcatagttttatatgtactgggaaactaaaaaattggtgacttgctttattgtgatattcgctttattgcactggtctggaactaaacctgcaatatctctgaattatgtctgtatacaaaaatcaataatgtttatccataacatagataaacagttagaaaatgtaatagaaggccaggtgcagtggctaatgtctgtaatcccagcactttgggaggccgaggcgggtggatcgcttgagctcaggagtttgagacgatcctgggcaacatggtgaaaccccgcctctaccaaaaatacaaaaattagccaggtgtggtggtgcacacctgtagtcccagctacttgggaggctgaggcaggagaattgtttgagcctggcaggcggaggttgcagtgagccgagatcgtgccactgcactccagcctggtgacagagcgagactttgtctcaaaaaagaaagaaaatggtgacatgcttgtgaaagtaaagagtattttgaataaatggaaagaaatatattcttggataagaagatacaacagcaaagagatgttaattctcctaaagttaatctataaatttaatgccatattgattaaaaaaaatcatcattgtctcctagaagctaggcaaactgattatatagttcttggaagaacaactaagcaagaatcacaaaggaaactccataaaagatcaataaggaaggctagcccttccagatattaaaatgtatttaaagcccccctcttggccgatgaattgacagaccaataaaataaaacggaaatatccagaaacaaacacatttgtctatggtaatttagtatatgacaaaggggtcatttaaaataattgagggaaacatacacttttcataagtagtactgataaatccagatgggatggccatatggaaaaagaaaaatacacatctgtttctcaccagttatatcagaactgattccaaatagattagaaacttaaatggagacagagagaccccactttaagtattagaaaaaaacatggaattcctctctaaccggaaagttgagaaatatttcctataactcacagtccaaagtaataagggaaaaactgatgaacttaactacataaaatacaaatctttacatatgaatactaccagaagcaaataaaaaagacaaatgaaagacaaatgataaaccgcattatgcagtaaacaggaataagaaatgtctttatacactgctacagactgaccccacgcgatatcactaagttataaaaccaaaggctggaacaatgtgcaaggtaggcacacgtacatgcagtatgtgtacagcacatgtgcttgcttataatttagaaatgaaaggacaaagcgaaaatctaagagtagttactatagggccggggggtggggagacaaggaatacaaacaggacagaaatgataactagaattttcaggggaaaacactttactgcatagatttgactttgtaacagtaaatgtcttatataattatgaaacaaaattaaatcaaaaattaattaaaatccctaaaatcaaaagcaaaatgaaataagtgaaccagtaaaacgggcaggtgccttaaccacagagagcggtttaaactgactgtaacatatcaccatttaattgtatatctcaagtggtttatttcctgaaggataatcaagagacatgggagctctggtggcctctgctcactggggccagcaagggaaaataaagaagagagacagagagacttaagagacctaacaacccaatgcaaaaagagagaaacaggcacacagaaatttgaacatgaggtatttgatgataaaccaaattattggtatctattagttgtgatcacggcattgtgactatatcattttaaaaataaaaaataagggccaccttctcttttagaggtaggcatgtatgtattttgacacaaaataatgtgatgtctcaggcttgctttcttcatccaagggagaagtggtggggtactgatgacgcaagaatgtccaggagtggctggcagctatagctgagtaatggatgcatagggttcaatatgtcattctctttacttgtgtatatagttgagatatccacaatgtaaatgtcgaaaaatatgaaaatatgggttcagataataactctgctacttagtcacacagccagtttgtaaaaatttcctatgttttgggaacctgaattccttccttttaaaaagaagacacataaacctaagttacaagacaaattagtatatgataaagaggtcacttaaaatcactgggggaaacaaatattacaaatttgttttattacatattacaaagcctgtcatatagcagaactaaacaaaggccagttattttttattttggtatgaatttaactatgccaaattactaaaaatattttcctaaacatcacatcaaagtaagatttcacatggagttttaaagaggaaataaagaatgaagccttttggttttataattacacaaaatagcaatactagaatagaactaaatttatgcccaaatgtattcctcaattagtgcccaattcaaataccagatacaatgatgttattctgagtaacacccataaaactacatataactattaccataaataacatttaatttgtgggaccgcagttgctaagcctgctgtacctaaaactttgctgacatattctgcctactgtttcataaaaaacacacagtaatcagattaggtcaattagaaagctacaggcaaaacattgttccctttcaaatgtcctggtaaatagaataattttaaaatgaagaaatatttgaatcaaaatagtcaggaacagacctcaaagcattaaagaactagatctttatactctcgagagttgcattcaaagactcaatcaaattcaagttcatcacatatgcaaaacggaacacgaatctcccattaaaattatcataactgctggcttattaaaatgcttgagtgcattagacatagcatagaaaaattcaatataatatcactccaataatgtttctatattaatctagaaaacatggggaatggccctaaagcaaaaagtgctgctacaggctcatgcagaattgaacttatggctgttgaggccaacccacctcaaagaggcaaaaactgtcacagcagcaagatccagaggccttcatccgacccgggtgggatgaagagaagaattctcagcactgacccacagaaggaggcgggaggctgtggtgagatgaacagactagcgcccactctggctagctctcaaggtgagatgagggtgtggcttttgcacggtggcaatgtcgatgattttgaaacctcatgacagtgtttctgaatgtccaccgaaacatggctctcacaggcaacaaaacactcctgattagaggtgtaaattttccgcgtttccagagagctcttcatatgttgatggaaaattcccagcaacaaacttgaaggagtaattgcaggcaggccgtgttttattgcacttcgttgcattgcactgcacagatactgcgttgttgataaattgaaggtttgtggcaaccctgcaaggtgcaagtctatcagcatcatttttctcacagcgtgtgctcacttcatgtctctctgtcggtatattttagcaatgaagtatttttaaattaaggtatgtacacttttttttttgttttttgttttttgagacggagttttgctcagtcacccaggctggagtgcagtgtcgcgatctcagctcactgcaagctccgcctcctgggttcacgccattctcctgcctcagcctcccgagtagctgggactacaggcgcctgccagcacacctggctaattttttgtatttttagtagagacggggtttcaccgtgttagccaggatggtctcgatctcctgacctcgtgatccgcccacctcggcctcccaaagtgctgagattaagggtgtgagccaccacgcccggccaaattaaggtatgtacactttttaaagatacaatgctactgcacacctactagactacagcttagtgtaatcgtaactttgatatgctctgggaaaccaaaggatgtgtgtgacttgctttattgtgataaccgtcttattgcaatagtctgcaacagaacccacaagctctccaaggtaggcttatacattttcctattggttggcttagtgcaaaagatgaacccaaactggcaaagattaggtagaaaccagtttctgcaaactgaatgctccctttctccaggaacatctaccatcacatagccatttcctctacaaaactgttaccaaagagaagccaatttgtttacagtcatatgtaaaattaaaagcaacgattaactgtataccacctaaagtacctactctattcaaaacaaagctatgaaaagtaagaacatctcattttgccatctgcactgcatactcaaaccaaggcagagccctgagaggaagtgccagggagaccctcacaaccgccatgggtactgaagacacgagaaatagttaatggcaggccacttcttacttcacttcagatgaacggaaatctgaaggcttccatgttctataaactcttgggttttcacattagagaccagtggagagaaagagaaagtgcaagccagacccctgctttaaagcactgaccattcttttggaacaagaagctcagacagccccagtttcctctgaagtagcacaagtcaatgcaggctgagtgaacagaggtcctgggttgttcaagtgccatctaattccctattgaaattcactgctgccatcagtccaatggcagagcatctgtgcccctggactagggaagcggagatgcccagatttctgacacataaaccactgggtgagaaattcatctggaataacaaatttatctttaaaaagccaaacaaggacatccagtttcagttccaacacgtaaaaagcttggagttgtcactcccatccttatgataagaaaaaagctgaacaaacagaaactcagcaacctttcttggacccctcagagagctgaggttgcagaacaaactgccactgggaaatctgaagagatgggaatgcacagggtcccggctgagatctgctcacctagagatgctgctgggccagcccccagttggagcctccaaacgttaattctgacaaattgctggaggctgagggtggaccagcctccaagtgagactgctggggctgcagttttagggggacaccctacacttttgtgtgttttgcctctgagaacatcaccagattctcagggttaagagccctgatggctgtagcaggggagggaaaggctagtcctagtgacaaatgaacagaaccttctccataacaaaggcctgctctccaacacagtattccatctgggggaaggcgttttcctgaccccatgcccgtgcagccttcctgtctcacctaaggcaggaataaaaggctagaaacgcttgttaaggtgatagcccagagatacaggcccactaaaagactgaaatttcatcatcagagtaaaacacaccacacacacaccttcccaccacagcaacagggctgcagtataactaccacaaattacagttgaaggagctgctagacacaagaaagcattcttagggaaatccaaagacaagaaaaggacaaaaacaagagaaataggtgaatttgaaccctctggcacctacagctacagcaaatattaagagcctaataacagccatattaatataaaacctcacaggtaaggcctgtttcctttaattcttattatctgatacactatatttggttttcagcaaaaaattagaaggcatggtaaaaggcaaggaaaaaagtctgaggagacagagcaagcaacagaaccagactgagacacagcagagaatttggaaggactaaatggggtatttaaaaccactgtgatgaatatgctaagggctgcaatgggaaaaatggacaaatatgcaagaacagatgggtggtataagcagagatggaacgtctgagaaaaaatcaaagaaaatgctagaaatcaaaaacactgtaacagaaatgaaaattgcctttgatgggctcataagtagaccagacacagctgaggaaagaaacagtgagcttgaagataggtcaacacaaatgtcccaaactaaagtgcaagaaagaatgagaaaaaataaaaataaaataaccaccataaaacactcaagaacagttgtataatttcagaaagtgtaatatatgtataacaggaatattaaaaggcaaaaagagaatggaatagatgacacatctaaagtaatataaactgataaactttccaaatgtaatttaataatgataaattaaattacatttattttatttaataaaataagctgatagctttccaaacagaccccaaaccagagatcaaagaagcttggagaacccaaacaggataactatcaaaaactctacgctgaggcatctcattcaaagtgcagaaagccaaagtccaagagaagatctagaaagaaaccagagaaaaaaataacaccttaccatagatgaacaaatataagaattacagtcgatttatcatcaaaaggcaagcatgaagagcgtggagtatttaaagtgatgaaagaagaaatcccaccaacctagacatgtatatccagcaaaattatcccataaaagtgaaaaagaggctgggcgcggtggctcatgcctgtaatcccagcactttgggaggccaaggcgggtggatcacaaggtcaggagttcgagaccagcctggccaagatggtggaatcccatctcaacaaacaaacaaaaaaattagctgggcatggtggcgggcacctataatcccaggtactcgggaggctgaggcaggagaattgcttgaacccaggaggtggaggttgcagtgagctgagatgatgccactgtactccagcctgggtgacaagagtgagactctgtctcaaaaaaaaaaaaagaaaaaaaaaagtgaaaaagaaataaagactttttcggagaaaggaaaatgcaggaaatgtgtcaccagcaaagtgacctgcaaaaaatgttaaaagtagttctttgcaatgagaacatatggacacagggaggggaacaacacacactggggcctgtttgggggagtgggcggggagggagagcattaggaaacatcactaatgaatgctgggcttaatacctaggtgatggattgataggtgcagcaaaccactatggcacacgtttacccatgtaaccaacctgcacatcctgcacatgtaccccagaactaaaaattaaaatttaaatttaaaaaaaaggagttctttgaagaaaggaaaatgaaataggtcagaaactcagatctacacaaggaaagaaaagagctttgaagaaggaataaatgaaggtaaaataaagtcttatttttcttatttttttaaaaatttgaatataaacttattttttaattgacaaacttatatatatgtattatgcacatcatgttgttttgaaatacgcatacattgttgaggggttaaactgagctaattaacacatgcactgcctcacatacttattttttgtgttaagaacacttaaaatatattctattggcaattttcaagaatacactacattgttattacctatagtcaccacattgtgcagtagatctcctgaacttatcccttttatctaagataaattttttatcccctgaccaacatctcctcaaccactcatatattttcttattcttaattgatctaaaagataactgtttgcttaaagtaatatgaaagaaaaataaatcccgggaccctaattcactatggcaaagggaaaaattaagttggaagctgagtcacacaagaagctgcctttccttttgttgcccagcagacagctaaagataaaaggccagacagaggccagctgtctccacgagtgctgctctgtgtttactttatcttgtgtaaagtgtcgacttgctgagcactagatgaatatataatcgattatttctatgtctcctccttttcacgtgcaacacgtggattcagtgatgtgaccacacccaccctccttcccttcctgcccacttttcccctttaaatactgaagacctcaaaatcctcttgggaaaaagtaagatcacagattgttcctgtggttttgtgttcctttttcccggatgcatccttaaccttggttaaataaacctctaaattgcttgagacctgtctcagatacctttcggtttacggtaataatagtcaacatctattgagtgattatagcatatggataaatgcaatgaatgatagcaatgtcataagaaatggaagaaggaaacagagaatactcatttataaggtacctgtgatactgtgaaatatttggtcttgacctctttttttggcaaacaattcctaaaatccttggaatccccaaagtccttttgctaatgatgctaatgttaactgacagcttcaggatggggttgctcactggaaagacagaggcaggattagagggttgggactttcagcccaatcccccaaccccagggagtggagagggcctgaaggctaagttgatcaccaatagccagtggtttaatcaatcatgcctacacaatgaagcctcgataaaaacccaagaggaccgggttcagagagcttcctgatagctgaacacacggaggttcctggagggtggcgtcctgaagtgggcatggaacccaagtacaccttcctcctatcttaccctatacatctcctcatcggtgtcctttctaatatcctttataacaaaccagtaaatgttaagtgtttccctgagttctgtgagctgctccagcaaattaatcaaacccaaagagaaggctgtgggaaccccaaatgaaagctgattggtcagaagtcctagaggcctggacttaggactagtgttgggagagggggcagccatgggttccaggctctgcaccagtgaggtctgaggttatttccaagtagaagatgttaaaattaaattagagaataagcatctggtggccactccctgctgtgtggggaaaacccccacaatttaggtcacagaaggttctgtgttgattatcgttgtgctgtgagagcagaggaaaaacacagtttgagaaattttttcccaaacagtacctattctagatatgaaccagtattgtgttatttgagagtgaatatagagtagttgaaaatgtagagtgaaaactctagggcaaccactaaaataatttgtaaaagaagtgtaattgatatgctaaaagaggagataaaatggattcattaaaaatgctctattcaaaccagaaagggcagggaaaaaaagggaaagaagtgaacaacaacaaaaaatgttacaaacatagtagaattttttttttttaatacagggtctcattctgtggcccaggctagagtgcagtggcacgatcattgttcactgcagccccaaccttcctgagctcaagtgaccttcccatcttagcctcctgagtagctgagactacaggcacacatctagctatttttttatttttattattattattttttagagcctggtcttgaactcttgggatcaagcaattggcctaccttggcctcccaaagtgctaggattacaggcatgagccactgtgcccaaccatgtagatatttttaactacatcaatccaactgtgcaataatcactttaaagtaaataacctaaatatcccaattaaaagacagaaactatcagagtagataaaataaaaagccaactatatgtagtctacaaaaaatccactttatatataaagactcagattagaagtgaagggatgaagaaagttatagtgtgctatgctaatcaaaaggaagttggagtaccaatattagtttcagagaaagcagactttaggacaagggaaattatcagaggtcaatacgagcatccatagtgatataaaggtcagtttccaagaagacataacaatccttaacatgtatgcacctaaaaacagagcgtcaaaatacatgaggcaaaaactgacagaactgaaaggaaaaatggacaaatgtactattatagttgaagacttcaacattttcttcttagtaattgatacatcatcaacatctatagactacatccaacaacagcagaatacacattcttctcaagctcacagggaacattcaccaagactgaccacattcttggccagagaacacacgtagacaaatttaaaagaactgaaatcatacaaagtatgctcttagaccacagtagaatgaaactagaaatcactaacagaaaaagatggaaattcccaaatacttggagattttaaaacacatttctaaatagcatatggttgaaagaagtctcaagtgaaatgaaaatatactttgaactaaatgaaaatgaaaatacaacttatcactattgtgtatagcaaaagccatactcaaggagaatttgcagcactaaatgcctataacagaaaagaagaaacgtttataaccaataatataagcgtgtaccttaggaaactagagagagaagagcaatccaagcataaagcaaacagaagaaagaaaatactaaaaattaaggcagaaatctgaatagaaaattgaaaaataatagagaaaattagactcagaaaaaaggatacacaaattattaatatcagaaataaattaagggattaccaatattaatccatggacattaaaatgataacaaaggaactctatacctctaaatttgacaaattagaaaaaggactaattccttgaaacatacaaatgaccaaaactcatacaaggagaactagatcgtctgaacaggtttaaagctactaaagaaactgaatcaataattaacgatattccaaaaaagaaagcagcaggcccaggtgatttcactgacgaatcctactaaacactgatggaaaaaatagtatcagttttctgcaatttcttctacaaaacagaagcagagggaacgcttcctaatttattctatgaggccagcattaccctaatgccaaaaccagatacatagagcataaaaaagggaaactacagaccaagatctctcatggacataaagttctcaacaaaatattagcaagactaaaaatgtatgaaaagaattatatacttcaacccaatgggatttattataagtatgcaagactggtacaatatttgaaaatcagtcaatgcaatataccacatcaacaggctaatgaggaaaaatcatatcacatcaattgatgcagaaaatgcatctggcaaaatctaacactcatttatgaaagaaaattctctacaaactaagaacaaagatgatcttcctcaacttgataaaaagtgtttataaaaagctaacatcacacctaataatgaaatactgcacactttcccccaaaaaagaacaaggcaaggatatcctctctcactacttctgttcaacatcatattagaagtcctagctagtgcaataagacaagaaaaggaaataaaaggtacatagattgaaaagtcagaaataaaactgtctttgttcataaatgatatgattgttcatgtacaaaatcccaaagaactgtcaagaaactctcaaactaataagctagcataggtcacaggatacaatattaatatacaaaagtcaattgctttcccatattccagcaatgaaaaattggaatttgaaatttaaaatgtaccattaaacactgcaccaagaaaacgaaatacttaggtataaatctgacaaaatatgtataagaactatatgtagaaaactagaaaactcaaatgaaagagttcaaagattacctaaataaatatagagatattccatgttcatggacagaaagacaatattgttaatatgtcaattcttctcaactagatctataaatccaatgcaaccctaatcaaaatccaaaaactattttgtagataaaagctgattctcaaacttatatgaagaggccaaagacctagaatagccaacaaaatgctaaaggagaagaaaaaagaagttgaagcactcacaatacccaatttaaagatttacaataaaaatagtataaacaagtcaacatggtattggcaaaagaacagacaaagagatcaatttaatggaattgagaacccagaaataaagcccataaatatagttaactgatctttgaaatatcaacaaagtcattcaatggaaaaaagagaagatttttcaacaaatggtgctggaaaaattggacatctatatgcaaaaaaaaagaaacctagacataaaacttacaccttactcaaaaaattatatcaaaagggatcatgcacctaaatgtaaaatgcagaactataaaagttctttaagaaaacacagaatatcttggtgatttggggtttggttcaaagacactgttaagagaagaaaaagagaagtcacagactgaaagaaaatatttgtaaaacacatatctgataaagaatttgtatccaaaatgtataaagaaaagtaaaactcaacaataagaaaacaaaatgtctaactttaaaagaaggtggctgggcgcggtggctcaagcctgtaatcccagcactttactttgggaggccgaggtgggaggatcacgagattaggaggttgagactatcctggctaacacagtgaaaccccgtctctactaaaaatacaaaaaaattagccaggtgtgctagcgggcgcctgtagtcccagctgctcaggaggctgaggcaggagaatggcgtgaacccgggaggtagagcttgcagtgagccgagattgcaacactgcagtccaggctgtgcgacagagcaagaccccatctcaaaaaaaaaaaaaaaagagggtaaagatctgaacaaacatcaccaaagaagatacaggaacagcaaataagcatatgacataatgttcaatatcatttgccagtaggggactgcaaattaaagcaacaataagataccattacatacctatcacaatggctaaaatccaaaaatggacagtatttgttgtcagttgctgatgaggatgcaattgctagtgaggatgcagaccaacaggaatttttatccattgcttataggaatgtaaaacagccacttaggaaaacagtttaaaagtttcttacaaaacgagacatagtcttattgtatgatccagcaatcatattcctaggtatttacataactgatttgaaaacacctgcatgtgattgtttatagcagctttatttttaattgccaaaaactgtaaacaagcaaggtatcttaaataggtgaatggataaacaaactgtggtacatctacataatgaaatgttatttggccataaaaataaatgaagaatccagccataaaacaatatggatgaatcttaatgcatattgctatgtgaaataagtgaatcttaaaaagtaacatattgcataattccaatgacatggcattctggaaagggcaaaacggtagtaatagtgaaaagatcagtaagagttcagggagagagggaaggattaaataagtgaagtccagagaatttttcagggtggtgaactatttttatgatatgtaattgtggatacatgactatgcatttgtcaaaacccattgaactgtacaggccaaagagctaatctgcagatatgctaacttttaaaaagtatttaaaaggtgggaggatctcaggatcctaattttgcaaaatgtgacaaaaaacaatctacgaaacaacctcactgaaaggggttggggggaaaaggtgctgacttaagtaactctgaaaatcatggagtctgtaatactaaaggccaaagaagctgtacatcagtgatgaactctagttgataaatttgtttcccaggtgggcagtggttaatagttctgataccactactcacgtattttgaaactgaccattaagtaaatggatggcagatggtgagaaccaggtttctcactgctggagtgggaacaggggaggaggctggactgatccacgctgtaaaggattggcattgaagacatcactatgaactcatgtttagcttaatagactattgatggttatatatagaaatagttacaggttacaggtatatacatgtgttggtatacactcatatacagtcgtcctcccttatatgtgtggaataccctattctaatacccctgtaggtgcctgaaaaaacagataatgctgaaccctatgtatactatgtgttttcctatacatacatacctttgataaaatttatcattaggcacagtaagagattaacaatgatccctaataataaaatagaacaactaggctgggcgcagtggctcacacctgtaaccccagcattttgggaggccgaggcgggtggatcacgaggtcaggggatcgagaccatcctggctaacatggtgaaaccccgtctctactaaaaaatacaaaaaattagccgggcatggtggcaggtgcctgtagtcccagctcctcgggaggctgaggcaggagaatggtgtgaacccaggaggcggaggttgcagtgagctgcgatcgcaccactgcactccagcctgggtgacagagcaaggctccgtctcaaaaaaaaaaaaaaaagtatgaattgttcatctctaaaatttgctatttaatatttttggaccatgattgaccgcacctaactgaaaccacggaaatgaaaactgcgaataaagaggaaccaatgtatttccttgttttgtcagctgagtgaacctagaagcaaaggcctctcccccacccagtaataacaagcacacctggcactgagattttggtttctaatgccaacctccaaccaaaagaaccagagctttcttggagaaatggccaatttgcccatggactagggcaggaaacatacaaaatgagccaggaacctcttgtggtgccagaaagtaagaacgtgataaaaattaataacctcacaatgatgggggtgtgtcaaaggaacacagaagccaacttttaacaataaagtaacattggattataactgtgagtataaaataaatatccatgagtccatatttctataaatacatgattgaacacacaagtaaataaatagtaaagaagggacaaatctcccaagggaaaaaattccaaatactttatgtagatactccgccctcagggaagaggaacatgattccccactccttaagtggaggctgcacatagtgacttccttccaaagaatacaatataggaaggtgggcaggtagaacttcacagtagagaaaactgccaatcactccctcagtgatcacctggctaggtgatcaagtcaacatcaacagtgatgccttactgatagtatgtccccctgatgtgatgagataagaacagtcttggccgagcgcggcagctcatgcctataatcccagcactttgggaggccaaggcaggtggatcatgaggtcaggagatggagatcatcctggccaacatggtgaaacccggcctctactaaaaatacaaaaaaaaaaaaaaaattcagccaggagtggtggcatgagcgtgtagtcccagctactcaggaggctgaggcaggagaaccgtttgaacccgggaggcagagactgcagtgagccgagatcacgccactgcactccagcctgggcgacagagcgagactctgtctcaaaaaaaataaataaataatggtctttacctctctggtcttcttcctccaaatccagtctaatcatgagaaaaacatcagagaaatcctaatagaggggcaccctacgtaacactgaccagtactgctcaacactgtcgaggtcatacgaagtgaggaaagtctatgaaaaagccacaactgtgaggagcctaaggcaacatggcgacgaaacgtgatgtggggttggatggtatcctgggagagacaaaaaacattaggtaaaaactaaggaaatatgaataaccatggactttacataatcataatgtagcgatattggctcattcattttaacaaatgcaccatagtaatgtaagatgttacaaacaaagaaactgggaattctttacactatcttggcaatttttctgttcatataaaactattctaaaggatgaactttatttaaaaatccaaatggcaatcacaacgcataaatatcacagccaaccacaccccaccccacagtaagttgcttttataaaccaacagctgctggttgctgcagaatccccagggccaggctcaggggctgtgtccccactatacccagggcaagcccctgagctgccactgccagggattcaatcccccacccaaattaatttacatgtggtgtgagttttacactgacggaatgagggcttaatgtttgcttggtgtaaaactgatgtatggaggaataattttagagcatgacttttagaaggaccaaagagggcagcttctcaatcggcagcaggtggcacgaggatcaatagctgacgtctgtgccgctggacagcaggcccgccgggaggagggaaaagcacaatggacacacatgaaggacccagtgaggactgagtgatgggctggggacacctctcatactaccctgtcatgaaggccacagtgcaacacaggagatggggaggtcaggtcagaacacctgtccggggcctctcgatgggcactaggaatctgagacgagtccttggcactgatgctcaaaacatctttcatacctccagaaattgactctcctaatccagtttcgagcaggagggactcatctatctatgtgcaactgacagaattagagggttcccttgtgacatctaaacatccccatgaactgagcatactgtatgaacactggtgcaccgatattcagcaatgacagcatgatcgttaatccaccaaccaaaaatgcaagctgagcggctgggaagacaagtcacttgcccttgcaggctccgtcttctcaccccaacaattctacttaagtaaagaaaataaagcacaaaagctttgaaaccacggctgatagtgcaggctcctcaggggaaaggcaggcacccgacagaccaagaatctggtttccacacccatcacacctgcagcactgattcaccagtgcagctgaggtgatggaagcagggaaagtctaaggggagggacaccgaatcatccccaaaaccacaacagaattttctctgtgaacctctccaacactgtcagcctgattcttctgccaggattaactgaatataaacacctaaagcataaataatccgtgtcaataatttaggtgtacagtaagataaagtgcactgctcaataggcaaaactacagacaaaagaaaatatactttaataaaatttacactagtaccagctaaacaagaggtcgaagaaagttgttaaatttctcatcgcatcctcaaagatataacaaagttaaacaggaaattacaaaaagaaggtggttttaaaattcagcaaaaaaaaagatgaaatcatcgtgaccccagtgtaactctatagccatagctttacatgtaaacactggatttaaaatgcaaaatctgtggttactttagaccactgagactcaattatttatgctgattatttataggtagcttctaatggaagttgattattgaatattttcaaagagaaaaaaaaaggaataaattctcatttcgctaaaaagctttgagtttttttcctgaagggaagaaaatagattaggtggtgtcctgagttcctctgcagcctggggtgctggcatgaataaataaccgtggtaagaagcaagcatgctagcagccaagccacagacaatagtgcccaatgcatcgcccatcttcagaaacgaaacatgttgcataagacattttcctaaaaacttcatacttggagccgggtggggtggctcatgcctgtaatcccagcactttcggaggccaaggcgggcagatcacctgaggttggaagttcaagatgagcctgaccaacatggagaaaacctgtctctagtaaaaatacaaaattagctgggtgtggtggtgggcgcctgtaatcccagctactcgggaggctgaggcagcagaatcgcttgaacccacggggcggaggttgcagtgagccgagatggcgccattgcactccagcctgggtaacaaaagcgaaactccatctcaaaaaaaaaaaaaaaaaaaccctttatactcggactttaagcatgagtctttctaaagtgcattctaattagagcacatggggctagataggggtgactggcagaaactggggaggtccgaaaatgcccccctcagagaactgacctaagaaagcagctagagcctgaggagacccactggaggtcacatagagtgaagtgacatgaagaaatggctatggacacagtcctgggaaaccagggagaggccagagaggggtcacagtctgtctttagagcagaactagaattaacatcaaacgccaccataagcagaaaatagaagctgatgccacctctgacctctgagctgagaaaagtgagtccatacagggctcatgaaggccttagaagggcctgcagagaagacaggagcactgtgcccaggaggcagcctggccagcagtccagagacatccagcaccccccgccccacttgacacaggcgcatcagggtgagcacctgtgatgagaatacccactccctgtgcacacagtacctgcatggccctcccgggcacccggctttggggggacacgtgggcagcgagctacacacagaccctatccctccagcaggatcccccttcctcatttgcattccatttagtgataagattttccccatagccttatccattttctcttactccccaaggaaaaataatcagaattattagttttggtggttatcctatgttatggggtgaatctgtccttcccccaaaattcacagaaattcctaacctccaatacctgagactgtgaccttattggaaataggttcactgcagatgctattgactaagatgaggtcatatgacagtaggggaggcccgcggtccaatctgactgtgtccttaggaaaagggggatttgaacaccgagacatgaacacgaggagaacgccatgtgaataggaggcagagacggggtgatgcatctacaagccaaggaacgtcacgtcacggattaccagcaaatcacaggaagctaggagggagacctggaacagattttccctcagggcctcgagaagaaatccacgctgccaacaccttgatctctgctttccagtctgcagaactgtgaaggaataaatttctgttgcttaagccaccttgtctatcgtactttgttatgggagcccaaggataggaatccagcctgtaatgtgaacttcagttttacagagatgttccagcaacttccccgggacatgataacccagaaaacaagtgaagaaggtcccgggggatcctgctgttgtcacacttcaaggtccctgtgcctgactcatgggaacccccaggccttccatcggagactacgcgactcttactagaagctcaggaaggtacacaacccagggcaggcagaacactttatctctaatgagcagcaagcagggctttcaaggcagttaagaatttcctagctgttttcttcctcatcgcaatcaattctgaaaggcatgttttcatagttcgaggattctaagggctacgatgaaagtctctgctattaggttaaacatttgaacaacatattaaatattcaaatagaacattaggttgaactttgactgagcgtattaaaatactttaaggttaacactgaaaaggaactttttgtagtaaattaaaggtggcttctcctcctgaaggaaagtggagtctaattcctagcctctcgcacaccggccggcctgtgacttgcgtgatccagcgaatgtgacagaggtgacactctgggacacgggaggctgagttgtaagaagcctcttggagcctcttagaatgctggctctggcagaagccagacactatgtagcaagtatcactcacgtggtgaggaagcccaggtacccacatggagacgccatctgaagacagaaaggtgtctggccagccctggctgctctgtctatcccagccaggcatgtgagtaaaggaacctttttggacattccatcgcagcagaaatgacatgcagaagacccagggaacccagccaacagtgggaaccaagatcccaaacgtatggccccagcacagctgccccggccatctccagccatcagtgagggttctagtcactggtctgtctctgggtcatcctgctaaattcctcactcacagaatcatgaaaagtggttgcttagtgccactatattttggggtggtttattgtgcagccatagataactggagcacacttttctgtgaagtattttctttccagactcgaacagttagatgggtttatccggaggctacggtgtaattgaaattccattaaagatgctttttaacaagtaagcaggactaatgtatcttcccactgcaaaggcctgcactatctttgccaaaccacatcatactctgtgaagtcatccagtacaacacgtaccccaagttcatactctttaacagctctctgaatcaaatggagacttagtcagggtgaacagtgtcactgcaacgcttgcaagcaaagtaggattcaaccccacagcagaggtcagaaatgccaataaaaatgaccttctggggtcatttatgggtttcacagctctgatttcaagaggtaccagatatgccaaagaaaatgtggccaaagacctggaaatacgggctcttctgattcagtagggccaggggtcgctgccccagccagaggtcagccaccttggggtcagccaccctggcactgcccagctaagacagtccccacagaacctgagagctggctctccattgtgtctctccagagaaacagccccaacttctgttggttgtctgtacagacttcaaaggaaaaatatcttcctcctatctcatgaaaacattccttgctggggctggacgcagtggctcacacctgtaatcccagcactttgggaggccgaggcgggtggatcacaacgtcaggagattgagaccatcctggctaacacggtgaaaccccatctctactaaacatacaaaaaaattagccgggcctggtgtcgggcgcctgtagtcccagctgctcaagaggctgaggcaggagaatggcatgaacccgggaggtggagcttgcagtgagccgagatcacgccactgcaatccagcctgggcgacagagcgagactccgtctcaaaaaaaaaaaaaaaaaaaaattccttgctgggacataaacccttttcctatcgtcatacttgtccaaactgtgagttcacagccaatgataattggatgcgtggcctctgctgggtagataacctatgccaaactgttttcaaatagacagaaaaccaacattaatatggtttgttgttgttgttttgagacagagtctcactctgtcacccaggctggagtgcagtggcgtgatcacagctcactgcagccttgatctcccaggctcaaacaaccctcccaccttgcctcccaagcagctgggactataggcacacaccaccacattcagctaaattttatttttttagtagagacaaggtctcactatgttgcccaggctggcctgaaactcatgagctcatgtgatcctcctgcctcagcctcccaaactcctggaattacagatgtgagccaccgcgcccagccttagtatgttttaaaagtcaaaagaaaacagtgtactaacagtgacctgaatctgcctgcacttggaggctcaccgttttcacgtgctcacgtatgccatctcctttaagcctcaggtcaagtccatgtcatgctcatttcagcaaaaatgtcaggcagctctccctggcccacagctggctcctggtagggcagtcaaagtcagatctaccagatgccagcacccatgagaaaaggatctggatggtgccaacctaataccccctccatccccagccaccagcagcgccgaggtccttccgtccatgctgtgtgcatggcttttctcatcccctctctgaccccagcagctgggtgagcatcttacagatctccttcccagatcccgtgcaaaatggccagaattctaggtctcaggctgttcatttgtttgatgtgaagttagacttagttaccttggtgttaggagagaacagtgtttaaattatgtgtggcaaggaaaattaatttgagattatgaattccctgcagcgttcaaagagtatcatggagcttaagagcaagttggctgggtctcagtttattgacctggaggaatgtggaaatgctaagggaaagcatggagctgaagagtgctgtgcggactgtcaatccatttccatctgaaatcacactggaaaacagaaaagcctacctatggatctgtgtgggggcatggagaacagtgtgggtggagatgcaaaaagctccacctcagagagctgggagggaagcggagtcagggagggctgcctgcctttttctgtagacattcccctactgattgactggtgacagtgagattttatcacgtttgtaatttccagaaggggaaggcacaatgactggttacagtgagattgtattacatttgtaatttacagaaagggaaacacacaaactgcaagagaaatagatccctagagagcgtggtccaagaaggctgtgtccacatttccacattccctgtggctgaatgcccagactttgagatcaaccccatcaggaagaaagttaaagacagaggctaatcagagtttggcaatgctgagagcttccacgtgccaggtcctgcctgggctctttacctatattacgtcattcagttttcacaacttccccatgaggtgtcatccatgttacaggtgagaaactgaggcacagagacagtagcaatttccctatgatcctaaagtgatcagaggtacagctgggattcccatccaggcatcccaaagcctgagctctctatgttgtgacacttcatagttgtgttgacttttatcaaatcattcaacctctttgagggtcatttttcttatctgtcaaatgaaggtgacaacaacaccttctttttgcaaagattcctttgcaaaaaggaatcttacatatctttatcatatgtatctatatcatcatacatgtacgtatatcatctcgcccagtgcctgcagacaggagactgcagagctatgtgcccaaccaacctcacagggagggcacttttgagtgtgggcaaggtgccatcaaatccactgataagggacagtttagggagtgaggagtgcatgtcccacagcccctctgcatataaggagtgaagaggagggtggtgatgaggtaggacaagggttggaataggagatgagactaagaaaccaggcagctcaggaggctgaggcaggagaatcacttgaacccgggaggcagagcttgcagtgagccaagatcgcgccactgcactccagcctgggtaacagagcgagactccatctcaaaaaaaaaaaaaaaagaaaagaaaaaaaagaaaccaggcaggcacagatggccacgtggagaggtcagcccctgagagggctctggaccacagcctgaacaaagagcacggatgcaggcagctgccttggaggacacagaggatgtctctttgtgtcgcctccatagggcactggtgtctggaagagctcctcggccagccatcacttagatggctggctgactgggttaactttccacccactccctcctccaaccacccagcttgatgttccttcaatacctcttcaacactcatgaggagggacgggagtaaactggttttcttttaataaaaaatattatgcctttctttttaattgcaaagtaaggtttttaaaaataccatttccaaataaaacggttgtgggaggcatagtaaacatttaaaatttacatcatacaatgaattattgattcccagcaaataatactccccactcagtttcagattttcagctgaatgtagcagggcccgagagcctgtgccaggcccagtcctctacatcagggaccagggaacacttggatggggtggggttttatgtgtctctccactgccctcaaaggcactgccaatctcagcaacaggaaggtgctgactcctgactcaccagctctactgcaagtccatcacctgcaaaacctcagtgatttggtccagtgatgtgctactgcccagcactagtggagttggcacgagatagggcccctggcagctgcccagcggcccacccctccattcggctttgatgccatgggagagggctggggccagtgacagtcaagacccatgggcccaggccttcagagtggctcttagcataagggagaagggggtcaaataagggagaaacagcagggaaaattgaaaagacattctaatggctagtggggtggagatggaacaggtaaccaggtctttctggggacagacaggcatgatatgagagatccatccaaggatccgtgtttaactgggacaggtgtgcagcttcgggatgtggggatgaactgtgaagtgaagacagaaagaaaattcgtgcgctgtaacaggctcagtgctctctctaccatatgtcaccataatatttcaatcattagatctgaactaaatacagatttaatttaccaaataacgttttaatgacaacagcagtggcccccagcagcactccaatttacgtacaacttcgagataaattacatcgtttgacttgcgagaaagatgtctaattaggaagatttccagatataaagaactgtcactgtaaggcatgtcatctcatcactctaaagtcactcattaacatatgaaaacattcccgtttaataaactgcttatgtcaaacgaggtcctgaagatgggacgtgggtgaaggtgctgcccagtaggcggctcaactgattcatcacctgatgttatcggccatggccatccctccgccttcagatggagtcgccagatagatatttttgccatacaaggttcttatttcattttatcgtattctgattttctagctgggtatatttcagaattagtatttgtgttaggataagacactaagattctcttgaagcactggtgttttacacagtttatcttaaaggctgcttccaagttgctgcaagataaaactgacttaaggagtctgtcaattagatgcaaccatggtaaccagagaaaactgcaaaatggccataattctgcaactttgccccaaatgaggacaaaaccaccctgtatccaatacaatacatatactgggttttgtagtggcatgaagaaatgccttctgaagttggcccagtttaggaggtatcaggaacgacatctcagtgggtttttgcaggaagaataggagtttgctgataaatttcatgcttcctctgtagacaatggggaagcatcagaggggacgtagcagggtgttgaagtgacaagttctacagcagggagggtggatttggagcagggcagggatgaacagagggccagtgcaggggaggggaccactcagaagaatgctacattcctttcagaccaaatgtgtttgcagcctcactgggaatgctgggttagaccctacaccaaaaactacctggaacaagagctgttctaataatgctaagcatatgtgaaactgtgatgattctaatattggaactttttattttaacagaaaaccaattatcgtaggaagcttctaccatctctcatccaacagtgttagcatgactgttactaatacattgaaaaaataaaaatagataatggagatctggcaaggtggccgaggaaatcacatgtatgagagatgggtggatgaaaaagtcccaaaccccttcaagaagcatccgtgccatttcaagctttccagaacttcagagtcatggactgtctactcctgtttctctgtatcctccccccaaccccagttttaatttccattctattttccctttatccatttactatttcacttatttatgactcaaatatgccaggccccatgggagagctgggacacacagtgaactaactggagccagcaccatctcacactatcactcccgccttccagtgaaggagagaaccaataaccacagggctggttagggaagtacaactgtgccacatactcccaaggagaggccaggtgcctctgaaggcttatagagtagacatgtcctgcccatcacaccttcgtcgtttgtgtcagagctacaactaaaatctagaattcctaatttccaccctactcactctgcctcattcatttttcggtttattcatttgctcattcatttgcttatacctttgttcactgcccattcattctttcaacattcgatcagttattcatccattaattactcacagggcaggccctcttgtctcagctcagctacaaggcacagaggcataacaaggctaatgaacactcacgggtcataaccagggtgctacgggcacattggccagtgaaagctgaactggtctgggcagctcgatgaaggctctgcagaagtggccctgacaagtgctagtgaatcactccacaacatgcaaacctgatcactaacataatatgcaacacacgctcacatgttccaggtgccgcgcagacaggacccctgccccttgaaagtcagagtcaaaagggggagtggcgaggaagcaaaggctgcatcttgtgtcaagcgccgtggaagggaatagtgaagtactcccgggtcttgggggccttctataaagaaggtggtagcatctgggcctggagcctgcaggaaaagaaccgggagaagcaccttacaagcacggagagaaaccgtggaaagttacagaaactgtcaggaggcccgtggcgctggactacaggatattgtcagatgaagtcagcagcttgagcaaagcattgcaggtggaggaaaatttttttaattttttcctatatgtgtcaagaagccactgaaagctttcagacgactttttattgacagaatcctatttacatctttaaagaagtatactggttggaccctcaagcccatagaggggtaatgttgcaagtagaaaagaccaccccttgctctaagtgatgaggcagattccaacccttggccaggccgccatgcagggcagaaggtgccctgattctggctgctgcagaagttgggggatggcaattgaaaccaaagaggtggccatacagatggcgatgaggggacggactgcaggtaacttttgaaggaacagctggtgggatttgtatgtgtatgggcagggaggtgagggaaagggactgctgtgcgttccatgcatcttgattccattatctttgtggccctaatgcaagctttcagctctataggaatgcgaaacaactgcagatttcccatcgggcacatgccagagataagtgcttcccagagattcttggttgttctcagtcttctgcatcacatgccatagtgcgacgaagtctcccttccgatgtacaggtctctctgcaggatcaaattccagaaccgggattcctgagtcaaagcgtgaattaacctataattgtcttaattctgaaaaattatcctcctggggctggttgggggggcattttacactcctcttagcaaaatgtgaaaaggtctgtttcaccccagcctcagtgaaagattatgttctccagcttgtgggtttttgcctgacatggcaggtgacatacaatatcttactgttgttttaattgtaatttctgttaccacgaggttcacagtgttttcatgtgattaggccatttctgtgagctctctgaccccgcccatttttcttttggatatttgtggtctttttcttataaacttctagaatgcaggaactattcacgatctgaattagaaatatttctcccagtttggtactttgcttctaagtttgcatactttcttagaaattttattttatttatttagccacgtaaaagtttttgctttgatatggtcacatttatcaaaatttgatagctgcaaagaatactatatgagctggtaaaaaggaatggggggggtggttcttcggtccagatttagaaagatctccaaatgcattgtgaagtggaaaaagcgaaggtacatattctacccctttttctctgagaaagagaatgtgggcacgtatgttcttatttgtttatattttcataaaggaagtatgataggttattttatatgtcagcttggccaagctatggtgcctggtcatttggttaaacactagtctagatgttgctgtggctgtccttttagatgtaattcatatctacaataaatagactcagttaagcagattaccctccatactgcggggggcctcatccaatcagtcaaaggccctcagagcaaagactgaggttccccaagtagaaggaattcctttcaagactgtgacatagaaagcccagctgagtttccagcctgcagaattcagactcacaaatgaaacctcaacacctacctaacctccagcctccctgctgccctacagatttcaggcctgccagcccccacaatcaggtgagtccattcctttaaaaaaaaaaccaggcgctctctctctctttctctctctttctctctccctctctgtctcttcctctcattggttctgttactctggagaaccctgattaacacgggaacacttggaggattccacaaaaaatgagtacagtaactgtgtgtgggaaggatgagggaggggtggtaatgggaattctcagtttaggccttgttatagttagaaactttaagccgtgtaaatatctcacctactcaaaacagaaagtaaaatttggggcaaaatcaacttttaggtataaaataaaataaatgctctataaattaagcaataaaggttatttgttttatagaaatttaagatacaaaaaaagagaattatccaggtttatccaaaagatgaactgctcaggaagaagacaatttttaaaagcactgagatgcaattcttttaaacatgaacctatataccatatttaaatccatataatattctacaaatctggtgtatcctccaagcatttgatacaaggtttaactctcaccaactcttccactcctgaccccaccaggtgggcaaacataacttgtggcaatctgcaaagaggccaggccacgacctgggctggagtggccagcctgtggctggggagactttccagggaacaggtgccacctccccaaaacgcttcacgctgcgtgcaaggattcagagatgtccagggtaaaccaacactttttaagccaaatctaaatgtttaataaaaactaagaatgatgcataacaagagcttcatcctggaagtacacaccattttacaggaaactcaaaccctaaacatatgtaatcttgtttgtagcagggaacttcctccctgctagattgaagaaaagtattaccatctgggacacattcctctcaccctcagaagaaggggctttatagaagggtctttacttttattagcagcaccctgctatgcacctgctgatgttcataacacatggggctttctgggccactccagtgactgctgagctggcacctgatgacatttcttcaagtaagttgccttagttgacccagctactgctccacaccagaggtggagtggggaggagtgtcctctggtggaaggtcagtgccacagagaaacactgggcactcagactgcattcggtcctgggacagacagcgtgtccccaagcatccacagtgcagcgtccacagagaggcctgactcccaggggctgacagaggcagaggacagagctatttattgaaatgaggagtgccctgctaaaagaaactgcatgcatagcattatagagccaggtaaactcatggtgaggagtctgtgttttggattaaacacgcacgcgcgcagacacacacacacacacacacacacacacacacacacacacgtctgtgtttaatcccagctctattacataactttctggaggttgtttccctttgccaaggctgcctttccctacattaagtgggaacaatataatcccaccataaagaactgtcatgaaatccgaacgcaatgatgaccactaaggctacaagtgcccgtaccgtaggtagtaagtgcttactaaatgctggctcctcctccgtaactgatgggaatattaggagacatataggtctttggatagttcttgaaagctgtctctagaggctgtatttggaaacatatcacatggatcatctcttgaatgaagttcctcgtgacccttaggcctttcaggagtaatgccagggtccttcctgtgagcagctcagccgagtggggctagcggggagcagagatggggctgggacagagcacaagcacagccctggggtggggtagacagggatgctgggcaagcacaccccacctccgctccccgccaaggctgtctgctttctgcaccaaggccccttctacccctgcaagcccacctggccccctgcacacaggagagttgatgcccccagaggaaacaattagggggaatgggaacaaggccccgcatgccctcttcagggggacagttctgggacattctgtacggctccaggcaccccccaggctcacagtggcagccctgataacaccccccagggattccttctcctgccccacatcccccccagctcctcacacctgcttccttgtcctgggctctgcttctgggctaaaaacaaccccagcggggagagctgttaggaatgcaaagaggagaccaaggacttgaggcccctcctatcacctcatttacatccccaggagtgcaggccacactgcccatcaaaagcacgtccccgtgaggcaagatgatgatgatcgcagcggacatttattacctgccagacaccaacctaagcaccttattattaactattttaattctcacaccaattccacaaattactatgagtttgttttccaaaagaggaaactggggcacagagaagctaactttctgaggctgcccagctggtgagcagcagagccaagcatcccgctcggcgaacgagctccagagcccatgcactcaaaggcagaagctgcgctgcacaacgacgccaagaagagaacctggagggtccaggctggcagaaatcagggagggcaagggcaaggaggaagccaaaagctaagaacaaagtcagacaaacgccgaggcagaagccagggaagcagagcatgtcaccaattactggggacatgctctgagagagagggtttgagaactgccactcaccggccggggactgcttgttctaaaggtgcctcaggctgaaatccagctgggcctgtgctccaagccaggagtcctggcacaaaaacacggatctttgctctttctgtccgcagggcctgggatctcagccccaccccaagacagtagaagagaagggacccaggcaggggctgtggtcagtgtagagcctctggtttactagggaagtcaagcctgctggttcccattttctccataaattactcccattaaagtcaaatatccacattaactaaatttttgatatttcacagaatggttccacaaaaagagtactttcatttagctttaaacagccctttctgctgacatccaaattcgtatttcacttccctctcatctttaattaaagcttattatcctctgtgtaaaccaagaagatttatgacattatttagtgagttttctttttttaaattataaataacagtaaacttcagaaaatgctccaatttcacagttatttgttttcaagatttttggccacacactaaagctaaagctaacctccaaaaggcgcaagtcacatcttaaatgaaagctctgatcaaatctagtcctccccagcttctctgggcataaattggaattttaagccataggccaagagttaaaactatagcttctgatttgcttccaatgcgatctgtaactagttattcatggtccaaagaaaagtttggattcatgtcagaaccgcctcatacacacagccatctgaaaagtcccagagaagccctgtttaaatgcaatccaaactgatcctgccatgtttcttctaaaagaaggaaccatttcctgtctcgtgtatggtttcttttcctttctttctttcttttttgagacaagatcttgctttgtcacccaggctagagtgcagcttcaccattatagctcactgtcttgactcatgcagtccttctgcctcagcctcctgaatagctgggactataggcccatgccattgtgcctggctaattttattttattttattttttatagagacaaggtctcgctgtgttgcccaggctggtctccaactcctggcctcgagcaatcctcccaccgcagactcccaaaaagcttggaattacaggtgtcagccaccacgctgagcctatggcatcttaatttttaaatttttcatctcttttcactattttttctacaggagatcattatttcatttaatatagatacccatagtcacaaagagacttaggacttcagaatcagaaaacaaatcaaaaaaatacaatgtcctactacaagaaaatagtttttaccttaaaaaccatggagaaaggaaagtgctaggaaacgatggaccaaagtgattgtgattgaaaagaagataaggggcaactggaacaaagcattcacatgaagtccgtcagcacctagaagggctcatcaggagtctacgcaggctcgccaacacagcagcaactgcaacactcactgctcttttactgacaggatcaaggcatgtagacacggtatctgcgaggcagaggtcaattcagatttttaatttctctcctgcagcccagagccttgtattgggagaccaaacttccattcactgtcatggcattctggagggcacagagagtcaggtgtaacaaatatagaggggcaccatctgggatgggtggggagtattgtcagattctgcgtcagggtgcaaggggtgggcgagcttaccagagtgaggggaaatctataaggaatacatgtccaaccttgcactagagtttgaaaaaacatcaacttttaagtgctgaatcctgaatgcatttattgagtccaaaaatatctgtgtatgtcttcaatgtgtcaggcactgttctcagtttgggcatgcggcagtgaataaaactgtcaagtaaatttcacacagtgagagggcaagaggcttgatacatcatatagggtattagaaggtggtaagtgggggaaatggaaacagggggaggtctaggacagggagcagcaatgttgaacgggtctggcctcactgaaatgtcaacagaacgagaagagggccgcagggctgcagctacgtgaggaacaatgttcccgactcagggagcagtgtggaggcgtgtggctggagctgagctggagaggagaatccaggaagaccggctcgggagtgggaggggtggttgcagatggaggagttggcttttagcctgagagaatgtggagtcttcggagcatttccattacaggagtgacaggatttggaatgagctttgaaaggttcgcaaaagtagctctgaagaagtggggttatgtggcttctgcaatgtgacccgcgatttggcacaaccttgagaactccagccccagtaggaaaatggccaaaggccataaagaagtcacacaagaattcacagaagaatattttcagccccatggtgtcatatgagtaaaaccacacagttccatttcagcaccaggtgggaacctgtctcctataagttaagcggtataaatgaaaatttaatcatgattttccctttcatagaattgtggcctaacttctgaattctgataaaataacttaacattggccaacaagatcactcagcatctgagacctaatttgataaccataactcaaatatctcatcaactgaagttgcaattaacaaaaagtccagttggcagagcagggcctggatgatgaacgattcacagctgatctggggctgccgcctctacggcggtgtcttctttccagaccccccgaaagttcacagactgtcacacatgcacacaactcccgtggccctgcaaaaccagctcccatcaggaaacatgtgggctccttcctgcatggtacagtgaaaagcaaaatcctaacgtacttactcgcattaaaaaaaataaaatgagaagactcagttttatgtctacacaactgcaaaaacaaaacaaaagtcagagatgtgaactccagattgttaacatatctgctgaaacaaacagaacagtttaatcaggaatgtgtacaagctatattgcatacaaattggcatcaatcatgaataaatgaattttggctttttgcatctcatgtatgggacttatttacatggcatactggcaaactggaatgtaaactaacaatataaatgatattgcaatttaggagcatccccaagctgccagaaataggaagaaggcagtgttttggtttcctacagtatggaaaacttatagtgataacccaactaattcatagcaagggggagaagacagcacactaacctttaataaattaataggattgggaggctaaggcaggtggattacctgagctcaggagttcgagaccagcctgggcaacacagtgaaaccccgtctccactaaaatacaaaaaattagcctggcgtggaggcgcgtacctgtagtcccagctacttgggaggctgaggcaggagaattgcttgaacccaggaggcagaggttgcagtgagctgagatagcaccactctgcactccagcgtgggtgacagagcgagactctgtctcaaaataaattaaataaataaaaataataattaattgattaattaattaattggagctgttttcccttttctgcaggtactgaaaaccatcttatgcctgcctataggcatctccatttaagggcttcccacaccctgaaatacaaacactaccaaccaagctataaattatattgctttctactcctgtttctactagctatttctttaaaatttgctaaaatctgcctacaaaactatctaaacttggtgtctattaagaaatagggggatttttcaactctaatttgagttctttaataactatttctgtttgggttttctatttcttcttaagtttggctatattatttataaattaagccatctcatctaaatcttcaaatatattggcataaggttgctgattatcatgtctgaaatctcttgtttatattattttcctttcatatttctccattattcatgtttcttctcttttattgtaatcaataacaggtgtatgtacttataactcttttcaaagaatttttgattgcctctattgcttcttggatatccatttcgttacttttcctttaatcttacttattctttttgtgaatgtatgcatttactttgattaagaatttcaaacagaaatttaagtttatctctggtgtttgtgaaatgtgaaaagtaactgaaaactgcaaaaacaaacaaaaactcctaaagctcccaccaaaagttttgcaataattattaatatttcataagagagggtgggtatggtggctcacgcctgtaatctcagcactttgggaggccgagttgggtggattacctgaggtcaggagtttgagaccagcctagccaacatggtgaaaccctgtctatactaaaaatacaaaaattagctgggcatggtggcgtgcgcctgtaatgccagctacttgggaggctgaggcagggcaatcgcttgacccaggaggcagaggctgcagtgagccaagatcacgccactgcactccagcctgagcaagagtgagactccgtctaaaataaataaataaatatatatataatacacatacatttatacatttcataagagataagagaacacatcaatgcagtcacaagtcacttaatgacaaagatacaatctgagaaatgtgtcattctgagcaatgcaaatggtaacttcatcattgtgcaaacctcagagagtgcactcgcactaacctagatggcatagcctactatacatgcctaggctatatggtgtagcctattgctcctgggctacaaacctgcacagcatgtactgtactaaacactgtaggcaactgtaatgcaatggtaagtatttgtgtatctaagcatatctaaacatagacaaagtgcataaaatgtgatacaataccactgtcctatatgtggtctgtcatcgatggaccattatagacatcattatgcagcacaaaactgtattttattcattccacagatgacatgggagtcttcttatttttgtaatcaataataacaggtgtgtgatcaataataacaggaggagtgatatgctaattaggaactaaggatgtgcaagataaatgtttatactccaagaatgaaacagaaacgaaaaattaaaagtaataacaataagatgattaacaatatcaatagcaactaacagtagtttcttggttacttatcacatgctaggtaatgttctaactatttcatatgaaatttatttattttattttattttgagacagggtctcactctgtcatccaggctggagtgcagtcattgcaatcatagctcactgcagcctcaaactcctgggctcaagcaatcctcccatctcagcctcccaagttgctggcactacaggcacatgccaccacacacagcttttttattttttttttggtagagatggggtagggggtttcactttgttgccaactcttggtctcaagctatcctcctacctccacctcccaaagcactgggattacatgcacgagccaccacgtccaactaattttactttctgtagacagggtcttgctatgttgcccaggcaacaatgtagtggcacaatcataactaactataaccttgaactcctggactcaagcgatcctcccacctcagcctcctgagtagctgtgactacaggtgtgtgcaaccataccgggctaatttttaaattttttgtagtgatgtggtctcactatgttgctcgggctggactctaactcctggcttcaagcaatcctcctgccttggcctcccaaagcactgggattacaggtgtgagccactgcacctggcttcataggaaatttaatcctcaaaagatcccatatagaatgatggaggttaacactgttctccccactttacagatgaaatccccaggaatgaaggcggtgagagctagcaagtgggtggtgtataaggcaaatcattattaatagccacaagcacattacacagagtcttagttttaacttcaatggaagttttattgtttttgacagttgccaaagcagatcagatactgtgattaggtacacggtttcttcctgcttatgaaattacattctgaagcccttcggtctcattccccggctgcctccactctttcttgtaaccgctcgcctgtcacctgtctgatgtgcatcaccagctcattcatcacctggcagatttactaactcactcatcatgcagacactgatgagcctgtccttccgcattcatccccacaccctggctgccgctcactctgacataccgccgcctgtcactgtttgccagccaaaccgatacttttcttaggagctgctattagctcatttgtcagattattttattcctttttgcttatcaacttcccttcagacatcttttagaattttttcttcttgttctcctctgccaaccacttggctcatttgcttatcacctgatattattcacccctcatcattcgacagcttttcagattctattagtcaacatacataatgtgagttctatctcttgtttctattaggttaaacccatacaaatcttgctctgtgccaagtgacttagaatttgcatggggatgacacttacattagagcatattcactatggcacatgaatatcagttataaaactcacattccctttcacaggtcagaaaatgtgggatagcagcagccttttaaaaggtaacacacagcggcatttttttttaatgtttaaaaatatataaataatttattctccccattgcacagaatggcaatatgttctctcctaggtgattgaaaaggtttttgtctttagtctcttatggactggtgcatttgatggggatccagaaaaaaagatgggactaagtgctgcacgcaaaagagaactggccatgaagaggacccacccgccagacaagagccctgtgtgtctgcctgggaaggagaggagctcattcctgaaggtcccacctggacgggctgtttgcttatgaatgtatgcacttaggtaggtaggtaggtaggtaaatgtgtctatgcatgtatacacataagcgtatgaatctatgtctatgggtgtgtgtatgttgcatggaagtacacatgtatgcagcaggctaacactgactgcatttactgtgtgcaagtctctgcaatatgctcccaagacacagtagctcatttagtcattacaacaacctttgcaatagaaataccaatggccacccatattcactggttctcatttgcctggctgtgttctaagccttgccaccacctgggaggtaggttctatcattttcccccatgaaataaatgaatgaactgagcctcacggggatagagttactcacccaatggaggagctcttatgatccccatgttaccagtggggagactgaggcacagagaagttcagaaagtcacttgaggccatacagtaagaaatagagtctgtacccttaagcacatcacactacttcccagtagagaaagatcaccttctgtgatgcttaattttacgagccaacttgacagggctaagaggtacccagagagctggttgagcatcatttctgggtatgtgtgtcagggtgtctccagaagaggctaggatttgaatctgtagactggagtagagaagatcaccctcaccaatgtgggtgcacctcatccagtccactgagggcccacatagaacaaaaaggcagaggaagggcgccgtctctctccccttgagctggaacatccatcttctgtccttggccatcagagcttctgcttctcccaccttcagactccaggacttaacaccagcagctccacccctcctcctgttctcaggccttcgggctctggctgaagcacaccaccagccttccagggtctccagcctggagatggcagattgtgggacttcttggccttcacaagtgcatgaacctattcccatgatcaatgtcctgtataccccattggttctgtttctctggagagtcctcctaatacactttccttttaagaatgtataaaaagacatacatatgtgtacacacattcacagctcaattaagacccttctatcatgagagaatggagacacgttctaagacactaggggatcgggggtgggagagggcctggctccaaaatagatattttgatgaaaccagagtaaattcttagaaattttctgagtctcacggtgataaacagacactgtctctatgaaacacgcacaagtttcaatgatagaaaaggaagagatgagaatagctagcgaccagaaggaaacacaccaagagaaaaggagactgccccaaaacagaaagagagactggaccagttaaaactctgcactggaaatagttaagaccaggccagatactgcaaaaaaagaaaaaactggtaaaaatattttctgtagagcagtattttacatttcccctcattttgctagatttttctgtttgccctccagatccaccatacacctttactgctgcctggaggctgatcttgatgaggcttccctgttttccactgggttcagacttgggcagcactgaggggagactggagtgggcaaggcatggcaactggggtatttgtttcctctctgctggaaaggaccagtgcctgcattctctcaccaaaggccacccctgtctcagggtgaatcctacgaattcaggtctcactccaggccccagagccactccctccctgtgctgttaaggtccaggagccagggcagctctcagctatggctagccctgacagcctcaccatttctgcccctacctttgtaaatagtcaccccattaaactccccattacccaatttaaatatgtcatctgcttcctgctgggatactgagtatgaagtgctccaggcatcccccaggacagagcccctgtatcatgatctgttttataaaccgtggttctggacagtaatttgagtttttaaaggtcccattggcttttttttttttaagcttaaaaaccaaagatgaagtttaaatttgagaagcattcatgagaatgccaaaaaagggacagagtgatacaaataaaaaaaaaaaacctcacacttggaggatcagaagctgagatttaaatgattaataatgcatgcttccagagaagagcccagaacaaatcattctgttctcattatgtagtgaaacttacactggcttcagacctttcctcaaattgctaatgccagaaaaactgattgctcaagaattctgaatctaaccaaattactcttacattgaaagtaacagatggctactttcatttatacactgtgggaaatatatatcacccatgtccccatggtgaagagatgaatgaaaattcagaacgtaagagagctgaagtcagatagtaagcaaatgatggagagtggaatggctgagctaaataaggggtcccacgaagaggaggctttataacctgagttccctatgtaaaattaaaatgtgaagggggttttagatgcacagaataaaaaatgctaatttactcatttttccataaggaaaagatgttaaaattgactttttttgggagtatcacttacctacgaggcaatgttctctgttccaatagcgatggtggtcacccagggacttacatttgctgaagctcattgaactctattcttaaaacaagtgcatcttgttctatgtgaggatgtgaggatgagaagatttttatctttggttttggtaatttgataaatgtagggttgaggatacttttgaaaaatcaacaagatggtctagaagtgaagaagatatgaaatgtatatatatgtgtgtgtgtgtatatatatatatatatatatatatatattttttttttttttttttttttttttttgagacggagtctcgctctgtcgcccaggctggagtgcagtggcgtgatctcagctcactgcaggctctgcctcctgggttcacgccattctcccacctcgcctcccgagtagctgggaccacaggcgaccactaccacacccagctaattttttatatttttagtagagacggggtttcactgtgttagccaggatggtcttgatctcctgacctcgtgatccgcccgcctcggcctcccaaagtgctgagattacaggagtgagccaccgcgcctggcctgaaatgtattttttaaaaacatattgatatagaagttaaaaataaggtaccaaggataagtgcatgagaagatatgcaagtcctctgcagaaaaaatcttaaaactccaatgaaatactctggaaaagaccaaaacaaatggagggatatagtattccatggtcaaggccatttaggatcacacagatgttaattctccctaaaatgatacacagataaaacacaactccaataaacatcccaataagggagtctttcataaaatccaacaagctgattctcaagtctccatggtagagcaaagggccaagaaaagcccagatgcctttggagggaagagaaagctgggggcccttcctcctcacaggtatcttgttgtacaggaactaccaaagcagaccaaaggggcagaactgagtgcctagaaacagacacacagagatacagaaagtgtatttacaacaaagtgggcactgcaggtcatggtaaaaaacagattctagtgccactacaattggtcacgcataaaagaagaaaagagaattcctgtctcacagcatatacaaaatttaattccaagtagattaaaggattaaatgtgaaaagcaacacttctgattctgtaggggagaaaaaaaaagaagcaaatgtttttacaacttcgaggtagggaaggatttcttaataaaagataatcacatacatgcacagaaagtatccccagtgaaggaattaataaattaataaagataaccataagaaaaatgacatggtaagtcaaagcctcggagggggtattttcacatattccaccaagaaatcagcaccagaagatatagtataaataacttttataaattagtaagaaaaagagaaatgacacaaatgggtaaaacacacaaactcacatattacagaagaagaaacacaacataaaactggttgatctcagccaggcgtggtggctcacgcctgtaatcccagcactttgggaggccgaggcgggcagatcacaaggtcgggagatcgagaccatcctgcctaacatggtgaaacctcgtctctactaaaaaatacaaaaaaattagccgggcgtggtggcgggcgcctgtagtcccagctactcgggaggctgaggcaggagaatggcatgaacccgggaggcggagcttgcagtgagccgagatcgtgccactgcactccagcctgggcgacagagcaagagagcgagactctgaaaagaaaagaaaagaaaaaaaaaaaaaactggttgatctcattaggaacaaggagagcaccaactgggactggagatgccgtggcacactcaccagactggcaaacctctcaaggcatgccatgaagaatgcggaacacttggggcacctacatgagtacagttgctttgggaaaaccatgcgacatcatttcatcaatcacactgcccatgacccagcaatttcatgtccaagtgagtgccctggaggaacccatgcctatgtacctgaggagacgggcatttaaacattcacagcaacacaggtcacaggaacaaaatattatatacatggcccatgcagccactgaaggagaacagacaaacatattgtgatctattcacaccatggaagactgcaacaacaatcaaaataattgatgtagagctacacatgaacacgtatgaatcaacaaatatcatggtgaatgaaaaaaagcaagtaatcaaagaacataaagtgcaattccatttacacaaagttcaaaagcaaaagtaagcagtacattatttagggatgtgtacatatgtgtaaaagaatgatgaaccttgaatctctgctctgaagacaggcaggagaccagatgggaaggagcccacaggagggtcctggagtgggcagcttacacttctggtgctggttggtggggccttcaattgcctgcttcatagcaatacatgaatttcattgtacgtgtcatatatttcatgtttaataatattttattaataaatatttcctaatttaaaacagaaaagatgaaatacattttaaacataactgtcagtagaaaaaaaagctagattcctacagtctaaatatttacataaagtaaagcactctcaacgtggtatttatcagaaaaaaaaaccagaataaaagacagaagtgccgaagaaacgtgtaaaaacaagaagataaaaagagtgactgaaacaatccctaaataagtaaagagatttcataataactcaatcccttattttaaacaatttgatttctataagatatgtacctgaaagaaaatgtcagagagaaattaaagaaaaactgatgggcaaagatatcaggcacattcaaactaaaggaaagcaagcccagtgctctaatttaaacaaagccaaattcaagacaataaaacactaaattgagacaagaccactttatattattaaaagatataatctacagggaatgaacagtaatatcccaacatccaaacagagcaaaatgtgacagaaagagccgcagtgaatatgaacatgaatatggatcatgtaggaaaaagctgttatggaaaaaaactgcaaaagctaacagtagctgtgggccagggcagaacacgaaggagtgttttctaagctgtttccctgcattttccaggttttctgtaatacacatctatactcacttatcaggaaaaccataactgtaaagatctgtgttttggtgaggatatcacacgtttaagaaaggcagactcctttcttcctccaaaagtcactgctgaaagtcatgatttttaaaacttctttttttctgaaccccaagacggagtcttgctctgtcccccaggctggagcacagtggcatgatttcagctcactgcaagctccgcctcccgggttcaagcaattctcctgcctcagcctcccaagtagctgggaataggggcatgcaccaccacacccagctaatttttgtatttttagtagaggcggggtttcaccctgttggccaggatggtcttgatctcctgacctcgtgatctgcccacctcagcctcccaaggtgctgggattacaggcgtgagccactgtgctcagccagtttcaatcaattattctatctattgttgaaccacacaaactaaagagcaaaacaaatttgaaacctttgagtcttccttcccttactaatcagaatttttatattttgacaaggaaacatagatctacagcaatttgattaaatacacatgaaaatcagggtaaaataaaattgtttcaacttcatcccactatttattgtatatcataaaattattcaggaatcaaagataaggttcatgaataatattcttcattaaaagagggtggatgtttgaaagaaaatctggtaactaatagcctataaggtagaattttttaaaacctgggtacgtagagagagttcctcagaattgcatattaaattcactttcaattagtatggttcagcattttattctgatgatttatttgtatgcttggtaatactttttaaattaactgtgccacagacagacatatcacatacttcacagttataataattttttctaacgctatatctttataacggtaattgccttctttctgaaagaatacgcattttgaatctagtgacacttcatttattacttttcttatattagagctacctcagcatattagattttttcttaatgacttttttctattaggagaccatgaagaccccagggcaaaggaagtccattaggaaaggggggcattttagaggaggcaggaatttctaaggtagacatcagacaattcttgtcaagaacagactgaacacgagatcctccatttcctgtgaactatagattaattttgatatctgtacaaacaagattatgaaatttgcaatattcatcattaatacagtgaattaaattcctcacatagcaaaacatacatcaagtatgtcactgctcactgcacctcccactctcagttgacacatcaccctgcacagctcctccctggacaactccagctgaccagagtacctgcttataccacgtggaacaggagaccgaggatcctctcaccctgacagctgccttgctctctcctggaacatagcagcaggtgattattcagtgtgggggcaaaaagagtccctatcactcctctggtctgagagccagatgctagagtatgtccaggaagcacttccgagaagctattccctggacaggctgagccgccttggggcagtcacccatctcctgaagccaggagtgctggagcacaggctgagaatgactctgaggctggagagaagactcaacaacctgttggtggctccaccacggctgtccctttctcccaaaactttctacagctcgatttactcctggacccctgcacctggtgcttttcctgcttcctggattttgtcttggttgttctgctggcctgcaaggagtctactctctgatctacccgcccaaactccacccatccaataatatttgggctgaatcccattctcactgtaagattcagtctgaatcagtcttctcctacttcaaccttagtggaagcagcatgacacaatgaaaagagcatgccctctgaaatcagacacacctagactcctccatccaagctttagcaattacccttgtattatgctacccaagtacataatccctttgaaaaggacatgctcttcaaatgcagctgtgaatacttgtcttgggccaatgtataaaaagcaccaggtaggcaccagtttcctcttatctttctaaataaaaattatatacaaaattcatttctcgatttctaacttgcagcaatttcctcccattatcttatacaactttatgtatctttaacattttattgatatttttatttccccaactcatatcataacctcacctagaacctaaacctaaataccatatcttaaccttcttagtttccaagtcattgcacggctcagggccctgtgcaatgcatttcattactgcggcacaacaggctctgagcctcatctcatggcaattctgacgaccactctgtgctcacggtgtgctgatggtgtcctttatgtatccaggacagatagaacaaggaactgctgaccaggcaggttacagaatcagcccagggttagacacttacaggtccaatggggaagcaccccaggaaacatgtaacaaagcctccattagcagcagctggacaaattcttcccctcttctggaaacatccttaagctttgctgatgcccacacctggggatactaagtggtttattgtaatcaagaaatgtatcatggtcttggggtccagctacatgcaactcacttcacagcacattaaccaacagacacggatcacaggaaaatcactccagccataaagaaacacacagactctgggactccatccagaggcacatcccagggcttctgagctcccagagacggcccccactcagtgctgttccacagaccttaccacccactcagtctctaccttcacaggaagagagtaacattacccagacagggctatgagaataactcactctttctcagaagcttctcagccagtcagaagcagcaatcagggaaaagttgattacaattgtttccaggtgaattcaagatgatgcatttaattatgatttttgagcacataattaccttattgggtatctttgtctaccttgtttttaatctttttttttttttttttttttttttgagacagagtcttgctctgtcacccaggctagaatgcagtggcgcgatctcggctcactgcaacttccgcctcccgggttcaagagattctcctgcctcagcctccagagtagctgggactagaggcacacgccgccacacccagctaattttttgtattttagtagagaaagggttttaccatgttacccaggctagtcttgaactcctgagctcaggcaatacgcccgcctcggcctcccaaagtgctaggattacaggcatgagccaccgcgtccggccccttgtttttcatctttctattctagctcgctgtcacttgcaaaaagttaagtttttatatattttcaataaaaaatgtgcctgatggattaaaagagtttatacttccaagtgaagtgacttaagcaaataaaaataattgtcatgtttcaataaaaattagtattttatcaacaactatttttaatttcacttggtcttgagtggtttccttatgttatactttagtctgtttcagtctcgtttttctggttagactatctttccctgctgatatttaatactgttagtaaatttaaaagaagcgtattagtccattttcataaacgaggtgggaggttgggatacttaagctgctttatgagcacagcaaaattctgcattgttttaaggatctgtacaaatatgttttcaccctacttccttcttttcttctgcacttaataaatgaaagcttcatctttaatgtgaccaagcaaaatacattctcttaaaaaaaaaggtcacgaccttgactgtaagaaatccccaaagtggatttataatgaattttccgaataaataatgactccaaatacatttacattaaaaatattaacctttaactcacctatatttttaatagcatataaagtgatatttgagctcaattcatggcttcgaaagaaagccttgcaggctttctataactcatattaaaggttaagatgattcataaatttttttccacagaatatggcaaacagatgactttgtagtgtgactgggactgaatttctgatgggcacagcaggaaacatttctgtaagtgcaaaaattcaaagacacttttgaaaagaagttaatatatgcagcgtaagattttaagctttcttacattgaaaaatgatcagcatagcaatgaagagagagaaataaaaaaaccactaatccaggctgaagttcattcatcacacacttccaattccttgatatctgcatgttacattaaatactgcagtggagaaaaacaaaaataagagaatccaactagaatggaaagacaatcaaagctatttttcttcaacagttgtctataagtttccaataaaattggggctatgacaagaatcgagcatttatacttatgcataaagtaagggctggtttctctaatagggctaattatcggacacctattaccaccactccggggacagcatcaatgaatcaaactccacaggactagaaatattctgactagtgtccaggataacaggagagctaccagggcttttggtgccacacacctgggtttattagggccagaattgctctccataacctaagaaccacccaaacatccgcaggataaatgcaaaaccctgggaaccctcttttttttgagagaagaaatatggaaggaaaaaaactttcctctattttgtagcttctaattaaaaggaatccatgaaagaattaattgcacctaaacgtattttactacgtcttacgttgtactgcagtaagtcttaagatgagctgcagaggggaatggattatgccttactaaggcatggaaagaggtttttttggttatattttaaggtctcaggtaaggcactgattaagagccagttggcctgggctggaaacctgcccaccacttgcctgccacacacctgccctgtgcctcagcttctcttttggctaggatgataacagagttgtctcactggggtgtcataagaagtaagtgcagcaggcatctatctgaacagggcccagcatatagcagtttcccaccacgcttgttattgtggaaggtacacagaaatggtcggatttctctgctgtgacgtccttccattcagctctcttgcggtaaaacgcttcagtctaagtgccttccttcacccagctgaaaggcagaacacttactcccgttttggataacagtgcaagctgtgagtcataactggtgtgggagacagagatagatcatgcctttccctattgttagtcatttcaaataaactgaatgtatcctggtttgggggtgatgcctttaaaaattttttttaatttaaaatttttttagttgactttatttttagaacagttttaggttcacagcaaaagttagcaaaaggtacagagagtcccatacactccctccctccccagaggcacagcctccgccactaccaccagccgccagcagagtggtgcatttgttaacaactggtgaacctacattgccacaccattatcactcagagtccatggtttacattagggtccactcttggtgttgtacattctatgggtttggagaaatgcataatgacctgtatccaccattatattatacagaatagtttcactgccctgaaaatcctctgtgttccacctcttcatccctctttcccaacctgtgacaaccacttatcttattactgcctccacagttttgccttttccagaatgtcatatggttggaactatacagtctatagccttttcagattgacttctttcacactgtattatgcaaagtttcttccatgtcttttcatggctaaatagctcatttcttttttttttttttctttttgggacagagtcttgctctgttgcccaggctggagtgcagttgtgtgaaatcggctcactgcaacctccacctcctgatttcaagagatccttccatctcagcctcccaaatagctgggattacaggtgcccgccaccatgcccagctaatttttgtatttttagtagagatgggatttcaccacattggccaggctagtctcaaactcctgacctcaagtgatccacctgcctcggctcccaaagtgctgggattacaagctcatttctttttagcactgactaatattctattgtctaatgtaccacagttacatatccattcacctagtaaagaacaaggttgcgctttttttaccccactgctctgggaatatagtttccaaaaattataaaaaaaaatacagagccgcttttagtatttctgaaggctgctctgatttgtctttgtcctttaaaagtctgcagaaaaaaaaaacaaaactgaatctaataaaggtgcttctgacatttctgcaacctaaacacgctttacttggtatcttccgtaccctcacaccagaagacgacacctttgttggttctgtttgttaaagactcagaagccagggccccagcaccacccagcaaccccccgaatcaaggtgcagcagaacccagcattcacgctgaaacacgtgtcctgtgctctgatgtagacccaaatctaacagccattgacatggactgttagatgacttccgttatcacctactgggataaaacctattttgttttggctaataaatactgttctatgtcattactattattattattttcgagatgaagtcttgctctgtcacctagtctggagtgcagtagcatgatcttgattcactgcaacctccgcctcccaggttcaagcgattctcctgcctcagcctcctgagtagctgggactacaggttcatgccaccaggcctggctaattttttgtatttttagtagagacagggtttcaccatattggccaggctggtctcaaactcctggtctcaggtgatccacccgcctcggcctcccaaactgctgggattacaggcgtgagccactgcatccgaccttcattaaatttaatgtattatttaaactaggatttttttatcagctttattgaagtataatttacataaaagaaaacccaaccatttaaaatgcacggttcctgacaaagtacagcctgataaactcatatggccatggaagcaccaccgcaattaaactacagaacattccatgtccccagagtttcccttgtgcttccctgtagccattctcttcccacaccccagcgccaggtgaccactcatctctcctccatcactagaatttcagaaaaatggaatcatacagtatgcagtcttttgtgtctggcttcttctatttagccatttgcttctgagattcacccacattacatgtatcaacaaggagaatctttttaaccccagaaatactctggctggaaagtagaaaactattcagcaaaagctactgtagaaaaacactccaagatgattaagaactgtattccacccctctcaaataagacccttgaacaacaagtgattcctattttaggacagcaaggagattgccaagtgatggatacaatgtatttattttttaaatatcttgctagctaaagacctttaaagatatttggagagagatgacatcagaaaaagtggcaaagacctaaaaattcactcctccataagaggaaaaaataactgaatgaaatggttagaatcaagttgctcataactctggaaattaaccaaaggcctgcagcaaccttggaagcatttcttcaagatgaagagctgaatctcggtaagaacagtaggatttggggcattttggcttgccctagtcccatcctccattcctcatctctacagtacccttgaaaaataaaagctcacatgcctggtgcagcctggaagccacttgagggaagggaacaaagctggatcttttccaaagtcccattcccaaataattctcatgatgtgaccattctggtgattccctagaagaccatacttacaaacctagttatatttgacctgaccctgagctcacccagtgtgaacagtcttttccctgggggtgactgtcaaatacatttgtaggcaagtgttttcactttgcagctgcctaatcagtagataatagttggggcaaacaatatattaatctaaacacttaaaaaaaatcctggggaataagatgcccatagcacttttgaaacgccccaatatatctctgggaatacagagtgccacatgcatgcatagcgctgtgcatatgcccaggaaagccctgagaaggctctaagctctcagatgacaactgccttgcagaatgtggaaggtgtgccccaagagtcacacagacccccttgtcaaagactgggagatgtactggctccaggcatttaaagaaatctctgtccaataactaggtaactcctaaactaacttggtagacaattcagtagccacacatgacaaagaataggctttacagaattcattcagaaaagtcatcaacaataaactatagtggacaagaagaatttgctttctagaggcaccacattatattagtgaaaatgcccagttttcaacaaaaaaaaaaaaagagaaatatgaagatacaagaaagcatggcccatattcaggcaaaaaaaaaaaaaaaagcaatcaatgtaagtgatccctggcctggcacagtggctcatgcctataatcccagcactttgggaggctgaagtggggagatcactcttgaggtcaggagtttgagacctgtctggctgacatggtgaaactccgtctctaccaaaaatacaaaaattagctgggcatggtggcacatgcctgtaattccagctactcaggaggctgaggcacgagaactgtttgaactctgccaggaggcaaggctgcagtgagctgagatcatggcactgcactccagcctgggcagcagattaagactccatctcaaaaaaaaaaatatatatatatatatctagctcacatatacatctcatacacacacatatatatacacacatacacacacacacatatatgacccctgagaaaggcatggtggacttagaagacaaagactttaaatcagttatttaaacgtattaaaagaactaaagcaaactgtctaaagaactaaagaaaaagatgacaatgatatctcaccaaacagaaaatattaatgaagagatagaaattataagaaccaaatagggctgggcatggttgctcatacctgtaatcccagcaatttgggagactgaggcaggaggactgcttgaggccaggagtttgagaccagcctgggcaacatagcaagatactatcattaacaaaaaaaatacacaaaaattagccaggtgtggtagcactcacctgtaatctcagctactcaggaggctgaggcaggagggagaatcccctgggcccaaaagttcaaagctgcagtgagctatgatcataccactgcactctagcctgagagacagaacaagactctgtctgaaaaaaaaaataaccaaatagaaattatagattgaaaagtacgataactcaaataaaaaactctctataggggttaaagagcagatttgagtagaccaaagaaagagtcatcagttaacctaaagataggttaattgaggttatccagcctgagcagcagaataaacaatgaagaaaaatgaacagatcctaagaagtgtgtgagccatcataaagtgtaccaaagtgcatgcaatggagtatatcaacaggagaggagagaaagtgaaaagggcagaaaatacctttgaagaaactatggccaaagacttcccaaatttgatgaaagacaacaatctacacatccaagctgaatgaaatctgagtagaataaactcaaagagatccatgcctagacatatcataaacaaactgtcaaaagccaaggccaaagagagaagcttgaaggcaaaagatcagtgacttaccacatacaaggggtccaaataagattaacagctagtttctcattagaaaacatgcaggacaggaggcagagcaaatggcaagaaaaaaaaaagtgtaaaccaagaatttcatatccagcaaaactatccctcgaaaatgaagaaaaaatcaagacattaccagataagccaatgctgagataatttgtctctatggaatctgccctaaaacaaatagtaaaggaagtcttttaggctgaaattaaacacacacacacacacacacacacccaggtgcacgagcgtgtgcaaaactagatagacagtaaattaaactcacatagacataaaaagcatgattaaagataactacatggatgctatggtttggatgtggtttgtcccagtcaaaactcaggttgaaatttaattgccaatgcaacagtgtttggaggtggtgtctttaagaaatgattaacttaagttggattaatgtctttctcacaagactgggttagttctctgcagaaaggattagttttgataagagttaattgttataaaatgaggttgcctctcacgtttttccctttttgcctttccctttatctgccatgtttggaggaagcacaaggccctcaccagaagcaggagatgcgattgtccaatcttgaacatcccagcctgcagaaccatgagctaaataaacctatttttttaaataaattacccaatctcagatattctgttatggcaacatacaacaaaaggtaagacatacagaaaacaaatagcatactgggagacataataattcctcatcagcaattacattaaaaaattaaactctccaattaaaaggcagaaatttcagaatggattttaaaaacatgatccaattacacactgtctataagagattcactagagtttgtcagtaaaaagtagaaaataatatactgtgcaaatgctaaccaaaagaagtttgagtaactatcctagtattagacaaaatcatctttaagacaaaaattgttactagaaacaaataaggacattttataatgataaaggcttaatcattcaagaatacagaacaattatagacatatttgtacataacaattgtgccagagtagcaaagaattagcaaagaacaacattctgaacagctgagctggtagctctatactgaaaaatgagaaatgtcatttgcctaaattattgacaaccggaagactgcaaccgagatcaagtgcaccctagaaagccacaggttttctatcctggctgcatattgaaatgatccacagagtctaaaactatagataccccggccctatgccaagaaatcctgatatagtgagtctgaagtaacatttcttaaagtgccccaggtgttctgaagtgcaggcaggataaggagacacgggcctagagtgtgagagcatgggctctgaaacatacagcctgggtttcaacctgagctctgcctcttactcgctccaaaaaaccttgaacatgactgaaccttgctgtacccacatcatggaagagtgtctggaacacatcatagaagacactaagaacagatttaaaaaaaaaactatcccagtaatgtgaaaatacatattctttattcatgtcgctagttttcagcatttagaaaggcacttataaatgttagccattactgtcgttgtcatcatcatcatcatcatcatctgtcatcatcatcatttgcccaggacaggcacaacttgaggtacctctgaaccctcacaatggacactgaagttggggaagaaagagacaaatggcagctttacctggtggaaaataagctcagctcttccctcttgagcctgcttcatcccccaggaagactaaagtggatcttgccagtcagcacaacagagctcccactttcaaagatggccttcacattctggaccacgcatactagggtggagtttaggaaaggtaaactgtgccaccctcccataccaccacacccccgcaaacacacacacacacacacacacacacacacacacacgaaaccaactaatccaacaacaccaactttctaccttcattaacatagtccttcttttgtaaatataaataggacaatgaaagatggcctgatattgagtgggaaaaaaatagcataaataatgacctagatgattaaagagaccagttaacctgtggggggaggtgagaatatctgataaacagaattctaattaatatacttgaaggagattgcacccattaaatgagtgtttcataaaatgtgaacatattgctatgaaaaaaagcaattagagaaaaacacagttcttagaaaataacataactgtctgtcaaaataaaaaattcaacagaatgatcaaacagtagaatggatacagctgaaatccaaagtagttatctagaaaataaaatagaagtgccccagaaagtaaagaaaaagagaaagaaaacattagaaaatgttaagaatcccataggatcaatttagaaggtagagcatctatccactaggaattcaagtaagagaaggcaaaaataaataaatagatagatagatagatagatagatagatagatagataaagagatacaatcaaagaattaatggaagaaatttccccaacaatttttcttgaactatccaatagacgaataactagaactagtttaataattcactatggtctgtgataaacaagtatgagatcaatacacataatttttccagaaattatggcagaaaatacagttggttcttgaacaacacaggtttggactgcataggtccacttacacatggatcttcttctacctctgccacccctgagacagcaagaccaacccctcctcttcctcctcctcctcagcctactcaactgatgacgatgaggacgaaggcctttatgatggtccacttccacttaattaatagtaaatacattttctatttcttaggactttttgaaatgatattttcttttctctagcttactttattgtaagaatacagcatataatacatctaacatacaaaatatgtgttagttgactatgtgatcagtaaggcttccagtcggcagttgcttacttgtagttaagtttttgaggagtcacacattatatgcaaattttcaactacatgaggggtcagtgcccctaactgccatgttgttcaagggttaactctatatccccatctctaaatattatagatattattttccaggaattaatctataaaatcaatgcaatcacaaaatcaaatcatggccactgtgtaactttacaaactcattctaaatttattgaagaatgcacagaagagcaaataatatgtgaaaataagtcatttgacttattataaagctggactagttaaaacaatgtagtgttgtcttagaaatgaactgatagattcattacacaaaataaagattaacaaacagacccatatctagcagtgaggtggtggaaaacatttcaaatggcaggagaaatactgaatcgttcaaaaaaaataatattgggaaaatggtcatccgttaggaaaagataaagttagagtcttcataccatatgtaaaaataagctttgattcaattaaacataaaaagaaaaattaaacattttagaaataaacaggtgaataatttcagaattatggtccaagagagatcttttacagtgtatattttaaaaagacactttgttaaaaattaaaagacaaacaaactgacaagacaaactgggataaaatattagtcacttaaaacagaaaagtattatgatcttaagaaaaataaaaagaaaaaataaaaataaaaataaggaaatgaggagaggtcccctccaaggagggacagtgacagtgaaggagaggagtgatttgaaagactagaaggtaagaaaatgacatattaataatttggttcaatatattgaatcaggtcggggtgaggaaggaaccaagggaacctgagtttaggttttagaataaggcaactgaaggaaagggagaaacattcctaatgagataggggagcaaaaagaaattagtttgggtttggagtagattgagttggggtccttgtaggataaatgctaacatggaggctcctccagtttagtctcactaggcagattcatttgagttaacaaaaaactaaactatagacctcatgtgaaaaattataagattgtgttgtgtttctgttttgctttcttttcattctctttattatttttttattttgctttcttttatttttatttttattgtctcctacttgagttgctttattgaatcttcttttgtagacaaataagaatcatataattgtttggatttaaatggttattttcaaattgcttaagggtattcgaaaacaacttctttccttgcaatttttaaaatgtccctttctaattgcttacatgttaatacagtcacacaacaaaataatatgcaactgtttaaaacagtttgtactaagaaatattagtgaatggagcaacagtcatgaaatactcctaagcagaaaaaaaaaggcaggttacaaaataggtgcactatgaatctaattttcataaaaatatgtacgcatctgtgtatgcatggggaaaaatggaaggcaaaacagcaaaatataattgtctatctctaagtgttgggatctgggatgatttttaaaaattgtcttgtgtttttatgcatttgctaaattcaaaacaatgaatatttaatatactagagtttaaaaattaaaaaaaagaaatctcacacatcaatgtaacacagtctcacagaaaaaatatgtacaagcaattcatggaagaaattcaaataggtaatggaatcttattctttgtttcgtttcggtcccatctattctttgtttcctttttcctgttttctgccttcttttgcattaattggatattttttattattccattccatttcctttgttggtttcttagccaactctttggggtttttggttttattttgtggttgctttaagctttacagtatacaactttaatttatcatagtttaccttcaggtgacattagacttcatcaagtatagtctaagaatcttacattgtatagttccatccgccctcctttacagtattttcacacaattacttattcaaatgttataaaccccacaatacattggtgcatttttttttcctatttttggttctttgcatgcattcagcttcttgaatctgtgggtttctagtttttattccattttgaaaaaaaattactactatttcttcaagtattttttctgtttgccctcactccttattccacatatattagtgtttctggaaattattccacaaagctctgtgatttttttccatatttttgttgaaaaaatgttttttctctgtgttcttcattttggagaatgtatattgcattgcaatgcctgtaagtccactaatcttttttcttgtctcaaatctgccattaatctcatccagtgaatttttttctctcttacattgtagttttcatcagtagaagttcaactgggttttttttatacctccatgtgtctacttaacttttggaacatacaattttaataactgtaatctttgattagatgatagacattaggaatgttatctagttggtgctggatacttttgtattcctatgaacgttctcaaactttgctctgggacacaggtaaattacttggaaactatctgattcctttggatcttgcttttaatatctgttaggcagaactggaacagcatttagctcaaggctagttattctccactactgaggtaaaactcttctgcatgctgtatacaatgcccaggtgaatcatgaggtttccaatctggatggtgggaaaaccctaattttgtgactggcacttttgtctctagtcctctcagatagttctttcatggcctcagtttctctacctacatgcaagagctgatcagtagcagctgaatattcacagggcttcctctccaaatctccagaaccctctacttgagtaagtctttcctctctggcactttgttctgcaaattctagccaccttggactcccaggctcagtatagcctccttaactcagcaggactgccaggctcttcccaggttcctgtgctgtggcctagaaaccttctcacaacaggaggctgcagcaatccatccccagaggatccagaggcacacctttctctacagttatgagaaataaatacgcgagaggaacctcagcatccctgaactcttcctggaggccacaaattacagttggaatttctgtgctgccatctaactagggtccctaaatgcaatgaagatgatgagaccccagggttgcaggggccaggtggcagctcttaattgccaaaggcatggtggatgtggttactgtgaagcacagagagccaaagcagccatcagagtagactggctcaccgagatctttggtgttggctctgaaaagccctgtttctctgattgagccgtgatggatacacgtttctgtctgggttgataaagcttagcaataaaaataaaccaccatctgagtaaggcaaaaagccagatccctcaaacaatgtaatataaaatgcaaacaatactaaacacattattggatctatatggtactcatattcccatagattagtgcttcttaaagtagatttactttgctttaaaaaaaaaaactgtcctaaactgtaactaatttgttattggtaaaaataaattctaaaaaatgttttcaactccatggttattagtttctcaacagtattagttattatgaataatctaatatccagttcagtgctactgtactcaaggttttaaaacttataccgcctgtgattgtgggagactgtttccattattcatacataagccatcacaagatggttcactgaatctttcaaaaaatcatctaatcagagctatataatctgatttctaattggcatccagcataatatagaacccgttatagtttaatgtaaggaagacaatgatctcaatcatagaagacactaagaacagatttaaaaaaaaaactatcccagtaatgtgaaaatacatattctttattcatgtcgctagttttcagcatttagaaaggcacttataaaacactatggtaaacacacacacacacacacacacacacacacacacagcatttcccttcttcccctccgacattgcattcgccagcctacaaagggaggcctccctcactgagtgctcacagtgagctgctgctcccctctctttgccctcccgcacatcagtcactccggcagggactgtacagctctccttcatctcgctctgtgtgtctgtaagcgcagaatgatgaaaagaaggagctgcagcagggctccggatggccttgtgcttgggagccctgcagaggaaagctgctgccaggagagcaatggcagcaccaaaacgctccagcagcaggggccactcatgcctgtactcagccagccaggcctgcagggcgaatggagtggctgcaaagaccttggagctgtgggcccaaaactgcttcttctcactatcctgagggatacgcccctttcagagagggcaactgactgtgtggtgtttatggaaggagttggggggagggcaggccagtgtgcccccctgggaatgaactagaaaactcactgctgcatctttagttgacacctccaggaagaaaaaaaaacaaatcattagcacagacaataaaagcaggagcttttattttaaaaatcattgaaatcaagacttcaagtcatgctagtgctaagtcccagggcagggtactttgctttctaggtcttcctttccttgcataaggtctcacacgtcatctggaaaacctcagttccattttgtggtccctgggaaaccatgaagggcttaacgaaggggagtgacacaggctggcagacactttacataccacccacggcatctgtgtgtgtgtggagaacggattggagaagagccagctttttggcacacagatctgttaggaggctactatatgagatgccaggcaaggacctgccctagaatggtggctcaaggcagagagaagacaggggcagctgcatacaaataaaatgagtcacggccaggcgcagtggcttacacctgtaattccagcactttgggaggccaaggtgggcggatcacgagatcaggagtttgagaccagcctgaccaacatggagaaaccctgtctctactgaaaatacaaaaattagctgggcgtggtgcgcacacctttaatcccagctactcaggcagctgaggcaagagaatcgcttgaacccgggtggcagaggttgcagtgagccaagatcgtaccattgccctccagcctgggcaacagagtgagactctgtctcaaaaataataataataataataataataataataataataataaaaaaatgagccacaaggagagagcttgtgaataagtatgatgggtgaggaaggagaaggatgtctgagtgtctccccagtttctagaatgggtaggcggtggtgtcatcaactgagacagaaaatacaaagggacaagaagatgaggttgaaggaatgtaagtcatgtgatacctaattagagaagaaagataatgtccacacagactacagttggctggaacaaaggaggatttgggagtcagagaggtttgggttcaagtcctagctcattacttaaggtgtggaagccttggcctcgctttaaaaaccttttttaaaaaaactcttttgaactttaaaaactcttaaaaaaaaaaaagagtaggaaaacctactcttgccaggactgttgtgaggataaggacatacaggtcccactcgatgaatggttaccatcattgtttacagtattttctttggtattattctggatagaacatctttggtcacatttccaaaactctgcggtgatggttcctgatggttccttagtcaactcggctagaccacagtacccagatatgtggtcaaacactagtttggatgttgctgtgaaagtatttttgtagatgagattaagttttaagtagaccttgaacaaagcagattaccctccataatgtagtgggctgcaaccagtcagtggaaagaagagaaaatgacggacctgctacagggaggagggaattccacctgctgcctcccttcaggctaaagctgcagcctcagctcttccctccatctccagcctgcgggccagcactgcagactttcgaattgcccgttcccacaactgcgtgagccaattctttaaaataaataaatctgtctatatacatatacatacatatataaaatttataacctagatatatatatacatctgtgtatgcgtgtgtatatctatctatatctgcctctatatctgtatatctcccattggttatgtttttctaaagcaccctaatagaactttatattgtagattttccttgcatctattgtgaatgcctttactcctcataaagccaaagccgaggctatctcaatggtcatgattcagagagtgagtttttgctaatgaaccaaaagattgcactgttgtggtcaacacagcagaagaacattctcatggtacagataaaaaactacccagcaaaatccatacacttccgtctgcagtgcagaactgcctctgggaagtgcctgtccagagaggcagtgcctgccacaggttcctagatgggcctcatgacaggctctcctgaatggcttgaaaggcaagcaatgaatgtcagtttcaggccaagaaaattaaactgctagggttccttttctgttctctattccctttcactgacttgccaggtccctgagcccctctgtgaagcctgccacaggccacgcctgacctggacaggggccagggtagccttgccctgaactgagccactgatagtcaggaggttgctccagcaattagtgtcaccctaatgataccctaacctccctacataaggcaaggaagtcagtcaagccacatgaaccccttctcctctgcctggggcttgggaagaaattagtccatggaaggtcagtgctgaccacctcccagagagcagactggccctgctccaactatgcggcagggctggggagcgagcactctgaacattctactcctgtaggtccagctgctgctacatccccccactgggatgagtcctgagaccccagcctgcttccctggcttccctgggacactcctcagccaccaccataaggggtcctaactcctcgtcagctataagcttatgcatcctgcatggtaaaatgcccagccctgtgagattcctgatgctgaggccagggctgggggtggcgcgcgggggtgattgggtgatggacgtcatttctctcttgtcttttcattcacacacccactctgcggaaggcggcttttcctttgtttagagagcttaatctgtctgcaccatgaaggtgggtgtggagtgaggaggcagctgtccccatgtcactgaaggcagcgcagtcaccacactgcataccccgaggatgtcaaccccacagtcagcctattcactgcatttccccttggcaccaagagccagcttcaaaataatccagcaaggggctggggggaggtggggggtggggagatagtgacaaaacaagatgggccagatgttggcatctgttgaagccagaagaggagtacacaggggttcatgacagcagtctgtttacttttacgtatgtttgaaaagttctaaataaaaatatttttctaaaaggaaattccttatatgagccgagatacagcagaagaggagcctcacctgactctaaggccactcctgtcttccctgataccatttcagggcgtcatggttactctcatgaaggaagaggtgtttttaatagacaaatgtgggttatttttctattcccattaatatttactacatgtcattatctccaagtctaatcacttaaagaggagattttaaataattgattaatataaaagaagaaaaatgccacgctgtctttttcattatctatcaaaacccagaaaacctcttcctctagtcctgacacagacacatacatatattaatgcatacactgagaagaacaggcatacaaatcaatagacacaaatctgctcagggcatttttccgagggaaaaaccattaacctctctccatctcccgcgtggcctgctcctcagcacaatgccacggcaattcaagtaactctttttattttactcacagaattttagggttcccccaaaaacacaaaaatctaacatttcttgaactctgataacatatattttgcttgtgcgatcatacatatgcatgtatagtgcataaacaggctttaatgtctagatgaaatgcatgcatccacacttttttttttttttttttgagatggattctctctctgcaccaggctggagtgcagtggtgtggcgcgatctcggctcactgcaacctctacctcccgggttcaagcaattctcctgcctcagtctccccagtagctgggattacagacacccgccaacattccccggctaatttttctaattttagtagagatggggtttcaccatgttggccaggctggtctcgagctcctgactcattatctgcccgcctcggcaccccaaagtgctgggattacaggcgtcagctgcgccaagccgcatccacacttttaaaatgcccttgttggccaggcgcagtggctcatgcctgtaatcccagcactttgggaggccaaggtgggtggatcacgagttcaggagttccagaccagcctggccaagatggtgaaaccccatctctactaaaaacacaaaaaaattagccgggcatggtggcaggcacctgtaattccagctattcaggaggctgaggcagagaatcatttgaacctgggaggcagaggttgcagtgagccgagatcatgccattgcactccaggctaggtgacagagcgagactctgtctcaaaaaaaaaaaaaaaaaaaaaaaaagcccttggttcacgctcggtccttacaggaggacagcaaaacaaaacaaacacaaagaggatgccctcggagcatctcagcaagacactgaggagcgctctcagaagcacctcccatgagaaacacagtgcttctcacaagcccatcagcattcagcagtgagattttatcaagctctgcttcccgctgcctgaaaagaagttggaattctcttcgccactgcctccaacctgctcacgcatctgaaggtggaaccctgctccaaggccacctggagacgcaggtgccacttaccacaagggagagaggcctcttccaggagacgacacctatgagtcccgacagcagcacctggaaggacaaaagatacaggaaggtgagatgcttccgaaaccttgcatgggcaatcaaaacactgtgaaccgtttcaacccggagaaggacgtgtggaacacagcacacacacagtggcggggctaccatgagctgcattttcacagcttgcacccactctgagaggcacattggtctctcagggcaccagggtgctatggaggggtcactttgtgcactgcactaggtggcccgagagtgacaggctttctgaaacaccccaccctggtcctcgatgtgatttggctgtgctaggcacacgcttgtattcctagctactcgggaggctgaggcacgagaatcacttgaacctgggaggcagaggttgcagtgagccaagatcacaccactgcactccagcctgggaggcagagcgagactccatctcaaaaaaaaaaaaaaaatcacagagaacactatttggggaaaaggcaaatgcaaccccacccacgggccacctggccacctgccatggttgcatggaccctgggcatggcagaccctgcaggctccttctgccctatacacacttggctcccctgatgcacacccttctctcccctccagcccctgcgagcccctccccttcactcatcacagcttcccacctcacccgtacataggcagtgtcttctgatgaggctccagaactttctaggccctgactccaagcagcccactcctttcccaggccaagtcctgcccttgaccttgcctggggtctcaccagaagtcatcccctctctcctgcctcctccctactgtcctgatcacatgaatacactgtgacttctgtcccttagaagaaccactgcttagccctgtgtccagctcctggcctgcctgtctcctaggcggcctcctgaggccaggcaacctgaggatgacactggctctgatccccacattcctgatttcctggtgtccaggaagggccaatggatcatgaagacacagtcacttcccacccactaccatctatctggcttcagccccacaactccaaggaaacttctcccaaggttccccagcagtcaccaagtgcgacagacaaagctcggtccccatcacccggctgagggctgaggctccctcccatctgggctcctgtggcttctcactcccctgcggttcttcccacttcccaggggccgctctcctccacagcctccctcctggcctcctccctctccccaacctcttcctggtttcccaacacctgtctcctgagccctttgtctcctctccccagggctctgtggtggctgtcctgaggctcctcgagtaccatccactggtatctgcacaggtgattctcagcccagggctttgccatggccacggcatcacaccgtccacaggctctgctcctggcatctgtccaacccaacatgtccaaaaatgcagctgcagcctccacctcagaagcccacacttcctcttgcaacctctgctctccacaagagtacctcttcttccccgtcactcaagccgaaatcctggagatctttccctctcccttacccccatgtccaaccagggaggaacaggaggctaaggctcactcaacagggcagcatgtgagaaggccgaattaaaaggaaggtgtttgcagaccaggtctcctgtgaagacaaattgctcacgcttgccactgtgggcacaagccaggcatccgggcactggctggaagggcttggctgcatgtcccctgagactccaaaagcactggccagacccgggaggagggcatgatgctgacaaactcacaaggtacccttggtcacagactgcagttcaccctcaaccacctccacagggggcagaaccaggtctcagacacagcagccactatcacatcctgcaccatgctagtctagtatcaaaaacatctggccacaaaacaacaaaacaacaacaaaaacatgaaccaaagcacgcacaccagggctctgctcccaagcctctcacacgtgtattttttctgcaacgctcacaagtcctccaaacacagttaccggcgacagacattatttacagccatttcccaccgcccgggtcccctcccatggccatgccacccaggctccttgcctcgcagtccagttccagccctagggaaatccttgaccaatgtctctcgtgtctctcaggggctgtgtctcactaactctccttccaaatgcccctgaaacctctctcttgccttctgtacccaacatttgaacccagtgggcacaccatgttcccatgtcatttcacagtcagaggacaccggcctttcttggaaggagatgaccattcccgccggagctctcaccatcatttcatgtttgacatttcagaccctgacttcactcctccacacccactttcttctttttgtgaattcaaaatttctgaccataatgccatcatgttttgagctcatggtatatagttcaggggccactccgtcactaagcaggatccattcttctgctcagcaccctccatttcccggttcatctctctgccctctgccggcacgctcctgtttcacctgcccgatgacagccttgtccactcgctcttgtctccacctcctccctccccactgaagccatcctggatgcctccaccaaacaaaccgcatcaccctggcctgacaatttagaccacaaagctaggtccctgattttccagcactggaggcacctcccttggtggccccactcctgtccaggccactctgggcacctccagggaggctggcaagggaggaaactgcacagcagccactgtgtgactcacctacaagccacagagctctgtgggctgtcttccctccacacccaacctccgagacagcccccatcttccagcactcccttcctgtccccagccctcccggccccagcctcagcccccgactcttcttatccctcaagttgagggccacattccggggctctggctctgactctgccatctgcctaggatgaaacttccaaaaagtgtcttccatttttccacacgccccaacactggcctcacgcagactaagcctggacagatggtgagaagaaacatcccctagaaaatggcgtcttctacttcccatgtctaccagatgaaatcttacccgttcttcaaccatggccccaccctcctcactcacgaagagcctaggaattcaagagcccagggggcccatcagatccccaaactaccaccagagtcctgcaggcatctttaataaactcagattgaacgccttgacctcttctcagctgaagtgtattaaactatcaaaattctacagtgactaagtcgcttgtagcaggaatttcactggaagtacataaaacttccaaatcgtagccactactccacctacttctaagcctgaaggaagttaatattgcttttatcttattaagctacagggagagttcttgaccttccccattcccataagcaaagctatcattccacaaatcccctcacagaatttgactttcaacaaacacgggtgacttgctcactgaagacaatgtgcatttccaagtatcattaataactacaactaggaatggatcaaattctcctacacaaagcaaaagaataaagccattaaacttggcgtggcaggcagaattctaaaatgacccctggtgacccctggccttacagaatgctctcccctgagtaagaatatgatgggctgtcactcttgtggtcttcccccagggacatgttcaaataacatggccccagcaacactctggttgcagccttgtgaaacctggccaggtgactcttctatgggaggggggcaaggaaatgctgggtagagaagggtggggtgcctggcgagggctccaccctcaggcctgtgcccatggacctaagtgagaacgggcaatcctgttttcatgcccaaatgttgcatcttccaagaccactctggcctcccatgccccccatcctgtgcccataaaaatctgagaccatagtgggcatggacacaagcagctggatgttgaaaggaggagaagggcacaccaacagacaccagcagacactggcaggccactgacggcgggatgacacagaatttggtcgagggcagtcggaggagagtccagccactggccggcctgactccaggggaagacaccttcccactccatccccgttttgctccccatccacttcgctgagagctacctccaccactcaattaaacctcgcacccatcctccaagcccatgtgtgatctgatttttcctgtacactagggcaagaaccaggatacagaaagccctctgtccttgtgataaggcagagggtctaactgagctgattaacacaagctgcctgcagatggcaaaactgaaagagcactctgtaacacacacccactgaggctttgggacctgcaaacactcaaccctagacgatgccgtggagatggagccccaaaacactccccaaaacctacccatcttcatgttcccccttggagtttgaacagcggggcaccgaagaagcgaaccacacccttgtcacacgcccggtgaggcggataagggaactcctccggtttcaactctactaagcaaggtccagactcctaacccaagaaaactatgaggtattaagtgagtgttgtgtcaagctgcaaagtttatggtcatttgctacacagcaacagaaaacaattgttagggactaaatgtatgtgaccccccaattggagatgttgaatccctaacccgcaatgtaatggtatttggagatggggcctctgggaggtgattaggattagactgggtcatgaggatgacgccttcacaatgggactggtagctctacacgaggagaaagcgagctctcacgctctccgcacacacacaatgaggcagaccattcagagtgcaagtcagttattggtgtataaaaatgcttgtgaattttgcacattgattttgtatcctgagactttgctgaagttgcttatcagcttaaggagattttgggctgagaccatggggttttctaaatatacaatcatgtcatttgcaaacagggacaatttgacttcctcttttcctaattgaataccctttatttctttctcctgcctgactgccctggccagaacttccaacactatgttgaataggagtggtgagagagggcatccctgtcttgtgccagttttcaaagggaatgcttccagtttttgcccattcagtatgatattggctgtgggtttgtcatagatggctcttattattttgagatacatcacatcaatacctaatttattgagagtttttagcatgaagggctgttgaattttgtcaaaggccttttctgcatctattgagataatcatgtggtttttgtctttggttctgtttatatgctggattacatttattgatttgcatatgttgaataacagacaaaaagagagccaaatcatgagtgaactcccattcacaattgattcaaagagaataaaatacctaggaatccaacttacaagggatgtgaaggacctcttcaaggacaactacaaaccactgctcaacgaaataaaagaggatacaaacaaatggaagaacattccatgctcatggataggaagaatcaatatcgtgaaaatggacataatgccgaaggtaatttatagattcaatgccatccccatcaagctaccaatgactttcttcacagaattggaaaaaactactttaaagttcatatggaaccaaaaaagagcctgcattgccaagtcaatcctaagccaaaagaacaaagctggaggcatcacactacctgacttcaaactatactacaaggctacagtaaccaaaacagcatggtactggtaccaaaacagagatacagaccaatggaacagaacagagccctcagaaataataccacacatctacaaccatctgatctttgacaaacctgacaaaaacaagaaatggggaaaggattccctatttaaaaatggtgctgggaaaactggctagccatacgtagaaagctgaaactggatcccttccttataccttatacaaaaattaattcaagatggattaaagacttatatgttagacctaaaaccataaaaaccctagaagaaaacctaggcaataccattcaggacataggcatcggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgccaaagggctcatatccagaatctacaaagaactcaaacaaatttacaagaaaaaaacaaacaaccctatcaacaagtgggtgaagggtatgaacagacacttctcaaaagacatttatgcagccaacagacacatgaaaaaatgctcatcatcactggccatcagagaaatgcaaatcaaaaccacaatgagatgccatctcacaccagttagaatggccataattaaaaagtcaggaaacaacaggtgccggagaggacgtagagaaataggaacacttttacactgttgtgggactgtaaactagttcaaccattgtggaagacagtgtggcaattcctcagggatctagaactagaaataccatttgacccagacatcccattactgggtatatacccaaaggattataaatcatgctgctataaagacacatgcacacacgtttattgcagcactattcacaatagcaaagacttggaactaacccaaatgtccatcaatgatagactggattaagaaaatatgccacatatacaacatggaatactatgtagccataaaaaaggatgagttcatgtcctttgtagagacatggatgaagctggaaaccatcattctcagcaaactatcgcaaggacaaaaaaccaaacactgcatgttctcactcataggtgggaattgaacaatgagaacacttggacacaggaaggggaacatcacacaccggggcctgttgtggggtggggggaggggggagggaaaacattaggagatatacctaatgtaaatgacgagttaatggatgcagcacaccaacatggcacatgtatacatatgtaacaaacctgcacgttgtgcacatgtaccctagaacttaaagtataatttaaaaaaacaataataataattaaaatattcaggaactatgaaaaaaaaaaaaagaatgcaagtcaggaaggagccctcaccagaaaccaagcttgctgacaccctgatttcagactttccagcttcacaaactgcgagaaaataaatttctgttaggtcacctagtctatgctatttcgttatggcagcctaagtagactaagacactacgacatccggagtgggacactggattgttgttccaaaacatctgctttctccccagacctctccaggaggggcagcacaggcttccctccccacacccctccccaatcctggaaacactgacacagctcccaacaccaatgcttgagcgcttggaactgactgtgcatgcattgcttgctgttcatcagtgagcttctgtggagccaagttggaaaacttttccctagaaaggtatagttctgccagtaacaggaatgcacccaggatttggaaacactgtgatgctcgagggcctcagctcacagcacagtagaaatcccaggccaagcccctaccttgccgtgggcatcaggctcagccacagtgctatggtggacactcatgctcagggcaagtcccttctccagccacatgccgcctgacgctgctccctgtcattgtgactccagccacctgccactctggcctcaattcattatttgtttatttgtttcttcgggagtgggacactggatcattttttcaaaacatctgctttctccccagacctctccaggaggggcagcacagacttcactccccccacccctccctgataccggaaacactgacacaggtccaaatacgaaggccaaatagattgggaaaggcatgatattgctcagggagaggaggcttaaccctaatgacggagggcctgcagaatggcttgagggaggcttttcacggcccaggtgctggtgtgcctcctccctggagaggccagctctggcccactggagaccaagggcggttgatgtaaaagcagctcagagcctctgctctgaaaccatcggatcttgaactgtttttgctcaattccagctaccagcaaggattatgttgcacattctgacatgtcagtaatcctgtaggttgattttgcaccactctcatgagaaaaagggtcatgaatctagttagccatgaaattaccgcatcatgaaaccttcatcccgtttaatttacaggtatcattattcagagtccacagttcacaaagaatatggagaaaacgaagagggttggggaagagtaacatagaattaaatagctgtggaaaaaaagccaaatagattggaaaaggcatgatattgctcaaggagaggaggccgaaccttgcgagcaccatgagttgtcacaaggacgccaactcgctcttttctccacttccccacccagcctaatagaggcaagagataaaatcagaacagagacagaacttcctgctgttgaggctgatgacaagggataacaggctgccgggaaataatggcatccttagagtcaaagacctgcccatttgattggtaccctgcctggacacagaggtctggaataaattagctctttaaatcttgtcctctaacactgaaaagttcttttacttcctaaaatcaagaatgttcttcagatcataaagtctggtccaaaggcaactgatagtgaagcaagtccttctagaacgcagtcttgaaagccaagtaaattactttcatgaaacatatggcagatgggtgcccaatagctacagagatatcaatttaccactaagaagccagcattcactgtgtgtggaaagaattgttgcaaaaacagagcaaataatattctgagtccaccaaccccccatcttccaaacctcctggactgcagctctgtgcaatattcctcctacagcctcctggagcagctgatcttcctacttcaccctccgtcaattctccttgctttgggtgtggctttctttctctgagtcttgctggggccacagaaggctcacgaggcatgcaggcctctaccatctgtctctacctttgaggacacactcattgctacccccaccctgtccatgctttctgccccctctccttagggcaacttccaactcaccattccctctcccagcctttcatcccaggctgtggtccaaacatcctccacaccatttcccttcaggggctgcaccaacacatcacactcataatgtccctgagaaaagttacctttcttctcaacctactgatagaaaaagaactctgcagctttcattatcttctcaagcagaagcaaaactataaattgatgacaaagatcacctcatgaaagagaaaaaactccttagtgttgaagtgttttaaaatattctaaataactcatgagtcaaaagatactgaaaggtgaaatacaccatggtctgttctgatgcaatgcatgcttctttgatgcacattctctcttaagtgcttggtaacaaactcatttgtccagggcctgccctgtaagatgctgcctcctcttacgggtatctactctgacattagggtagctgctggattttgttacttagtgggttattaggtagcacatatattattataatacattttaaaatatttttagtttaaaaatttcaaaataatttgtttcctttgtaatagtttttttggttttgttttttgttgctgttgttgttttgagacagagtctggctctatcgcccaggctggagtgcagtgacacgagctcggctcaccgcaagctccgcctcccgggttcacgccattctcctgcctcagcctcccaagtagctgggactacaggtgcctgccaccatgcctggctaattttttttcctattttttagtagagacagggtttcactgtgttagccaggatggtctcgatctcctgacctcgtgatctgcccgcctcagcctcccaaagtgttggaattacaggcgtgagccactgtgcccggcctttttttgtattttttagtggagaaggggtttcaccatgttagccaggatggtctcgatctcctgaccttgtgatccacccgcctcggcctcccaaagtgcagggattacaggcgtgagccactgtgcccggcctgtaatagttttatttcatgcttttaaaaaccttattctgagaagggatccacaggcttcactagattgtcatgacaaaagttatgaccccccccacccccgaccccgattaaagttcctttagagcagattttttggtgataaactcccgtttttggtttatctgtaaatagcttacttcgttcgccttgatgcttgaaaaatagttacgctggaaacaccctaggttgacagttgcatctctcaacagtttgaaactattattccactgttttctgactgccattgttgcagccaagtcagctgtcctcattctctaaagacttttgagatcatctccttgcctttagtattctgaactttttgcctggtatgttaggtgtggatttctttttaatcttctttgagagatactgtgctactgaatctgtgaatttatatttttcattcgttctggaaattttgtagctaatatctcttcagatattgtatcttcgctattctctttgccagggactccagtagctgtatgtttgtccttcacattccatcctccaaatgtcttagtttttcttccacatattccccacacatgtcattcatgacttcattctggttactttctttagctgtgtcttccagatcatcaattgtctctgcactgtgtctaatcagctgttgaactatataactgcacttgtttagaaaagttcagtgattatatctcaatatctagaaattcttttatttccaaatgtaactatttatttcaaatagttccttgttgtgtgctcatctatatgactgtgttgataatttctttaaatgtttcatacactaatgttctagattccaagacatgttgtcccaggagggtatcaaagtttgccctttgttgtctcattgtgatttgctttctttgatgcttgagcgcttggaagtgtttgactgtgcatgcattgcttgctgttcatcagtgaacttctgtggagccaagttggaaaacttttccctagagaggcatagttctgccagtaacaggaatgcacccaggatttggaaacactgtgatgctcaagggcctcagctcacagcacagtagaaatcccaggccaagcccctaccttgcagtgggcaccaggctcagccgcagtgctatggtggacactcatgctcagggcaagtcccttctccagccacataccgcctgacgctgctccctgtcattgtgactccagccacctgccactctggcctcagttcattatttatttgtttgggagtagggcagtggaccttgatgatctgcaatgcatcaaggagcatgtcttttgcagtgtatagttgttctataggagaagcatccttcaaagtgcctactcagccaaaatgccagaatcagaaggaaatcccccattcctggtgtttttattggtcccataaatacaccaataaagcaatgaatagaggctacttttatttttttttaaattaacaaatgttataagttatcaaaatatgaaactttatttagctaataaaattctttataaattccaaagtattccacatatcctattatttatttactcttttagccccagcaactatatttctcaaatcactttactttcaaaaaaacaaaatgttatcccaaattattctttccctccattttcccctggaaaaaaatattactcccatccaaagcctttctaattcagtagctttcctacatgctggtaagaaactgtaagacaaggattccattcacaaaagcaaaaaaattaaaaactatccaagaattaacttcatgatgaatgtataaggttttttaaaaggcaactacaagactctactgagacataggaaggaagatttttagtaaatggacgtatataccatgttcccaaatgaggaaacctaaagataataaaaatgttaatttctctatattcataaattaatttagtgaaatctctatcaaaatcccaatgggattctttgaaggttgacaaaatgattcaaaaatttatctgaaggaaaaatttttccttcagatagtagagaagaaacaatgtcattgaactatgtggagggaaagaggtttatgtattactggacacaattttcatcccttcattattttaagttaaaaattcccaggaacaaaaacagtttagaaagccacaatagttataagtggctcaagaacaaacagacctgtaaagaacagaatataatgtccagaaagagacttaggcatatattagggttttaaaaaattatttgttttttagattgtggtaaaatgtacatacataaaatttaccatttaaccatttttaagtgtacactcagtagcattaagtccattcaccttgtgcaaacattcccctcatccatctccagaaaacctttcatcttgcaaaattaaaactttgtatccattaatttacaccgattccccattccctcccccactctagcccctgacaaccaccattcttctttctgtctctatatgagtggaatcatagttttatccttttgtgacaggcttctatcacttaggataatggtttcaaggttcatccatatgtagcatgtgtcagaatctctttttttttttttttttttttttttgagacagttttgttctgtcgcccacgccggagtgcagtggtgtgatctcagctcactgcaagctctgcctcctgggttcatgccattctcctgccttagcctcctgagtagctgggctacaggcgcccaccaccacgcccggctacttttttttgtatttttagtagagacggggtttcaccatgttagccaggatggtctcgatctcctgatctcgtgatccgcccgcctcggcctcccaaagtgctgggattacaggcctgagccaccgcgcctggcctctccttcctttgtaagtctaatagtattctgtacgtatagacctcattctgttgagccactcgtctacagatggatgcttgggttgcttccaccttttagctatgaggataatgcttctatgaacacaggtgtgcaaatatgtctttgagacccttctttcaattcttttgggtatgtacccagaagtgaaatatggtaattctatttgtaataatacagagtggaaaacagtataaacctcctcaataattacaaatagaattaccatatggctattatttttataatagccattctgatgggtaggaagtggtagtcattttgattttttctcttttttctttctttttttttttttgagacagggtctcactctcacctaggctggagtgcagtgacgtgatcacagctcactgcactttcaacctcctgggctcaagcaatcctccctgctcagcctcccgagtagttgggactacaggtgcatgccaccacacccagctagttttcgtatttttttttctcaagagatgggggtttcgccacgttgcccaggctggtcttgaactcttgggtgccaacgatcctcctgcctgggcctcgaaaagtgctgggattacaggtgtgagccaccacgccagccattgttgtgattttgatttgcatctccttaaggattagtgatgttgagcatgttttcatgtgcttattagccatctgtatctcttctgtggagaaaggcctagtcaagccttttgcctatctttgaagctttcctcccagctttattgaggtatgactgacaaataaaaactgtatataaaatgtacaacatgattctggtatacatatactgtgaaatgattaccacaatcaagctaaccatatccatcacctcactagttaccatttcttctgagtgtttgataagaacatatgaagtctctttcagaaaatttcaaatatacagcacattattattaagtatagtcactatgctgtacattacgtctccagaatgtatttcttttataactgaaagtttataccctttgaccaacatctcccctttcccctctctcccccagccccgggcaactacgcttctcctctctgttaccatgagtttgactttttttttttagagtctacggacaagtgagattattcagtattcatctttctgtgtctggctaatttcacttagcataatgtcctctgggttcatccatgttgccaaaaatcctttgcccatttttgaattgtgttctttacttttttgttattgagttttaggagttttctatatgttctggataataatttctgatgaaatatgtgattttccagtactttttcccattctgtgggttgcctgtttactctcttaatagtgtcctttgatgcacaagtttttaattttgatgaagtccagtttgccacttttcttttgttgcttatgcctttggcatcatatccaagaaatcactgccaagcccagggttgtaaagcttttcccctaagcttccttctaagagttttataactttagctcttatgtttaggtctttaatccattttgagttaatttttgtataggatgttagttaagggtccaacttcattttttttgcatgtgaacacattaaattagtttttacaatttaatttatataattcagttatacaaggagtgacatagtaactgatgggggaaaaggctattcaataaatggttctgggataattgttaaatgtaaataaataagcagatagagaaattaaaattagttccctcccacaaaccaaaatacattacaagatgattaaaatattaaatgtaaataattaaccacccaggttactggctaaaactcacagaaaggcaactgctcctcaaaaaaatttactgagaggccaggcacagtgggtggctcacacctgtaatctcaacactttgggaggccgaggtgggcagatcacttgaggtcaggagctcgaggacagcctggccaacatggtgaaacctgtctccactaaaaatacaaacaattagccagacatggtggtatgtgcctgtagtcccagctactcaggaggctgaggtaggagaatgtcttgaacccaggaggcagaggttgccgtgagccgagattgtgccactgcactccagcctgggcgacagagtgagactccatcttaaaaaaaggaaaaaaaaatttactcagaaaaacaccttataagtaagtaatcaataaaatgcaaagtggaataagaggtcccttgctgcctgtcaagctagcagtggttagaaagaacagtggtcctcacttacagggctgtagagaatgtacatcattaagaggtgcgatgctgtcaactggcaaaaagtataataaacaaagcatgggctctatgcaaataaattcaaaacccaggatgacaaagataacttgctaaattactacaattgattccccaaaagaccaaaacactaactgttcccataaacaccaagaaattggaaatatgctcaaacagctgtaggcaaagtcttcaaaaacttctacgtatgaagatttccaaagctgtttaaattttttctgagcacagagggaaaaaagggggaacttccaaattgtctttataaaggtcagtgtaacaatcacaaacctgtaaaatatcacaaaaataaggaacagaccagtggcttttaaacagaagtacattgtttttattttatttttcctgtgctggatcaatatttaatgaatttcccccatgtatcaggcattgttggactctttcagatatttaactccttccccctcattatttatttggcaaaagttacattaagttattccctcccctcacaaagcaggttctccctgacttcaagggccaacatccaaacaaaaccaaacatgaaagacagagactcaaaaacttagcattcctcatctactacacatactagatataaacacacaaatttaaatgccaaaaactcataggacagtgcattaaaatgataattttactggtacatcatttttaaataaaaggttagaaaacagaattcagcagtacatttaaaagaatgaagaacatgggggttcacgtcaggaatgaaaagatggttctgcatattaatgtgacgaaaatgaaaaattctttcattcagtagatgcatggaagacgtccaatagaatttgatctccatcctctcttttaaaaaagaactcttagggctgggggcagtggctcacacctgtaatgccagcactttgggaggccgaggctagcggatcacttgaggtcaggagtcctagaccagcctggccaacatggtaaaatcctgtctctactaaaaatacaaaaatcagctgagtgtggtggcacatggctatagtctcagctactcgggaggctgaggcaggagaatcactggaacccgggaaacggaggttgcaatgagccaagatcacgccactgcactccagcctgggtgacagagcgagactccgtctcaaaaataaaataaaataaaacaaaatgattctgaaagtactcgtgtggtatgcagaattatgagatggcccccaaggtccccactccctggtgtacctgccctgtgtaatcctctcccttgggccgtgggtgggactgtgaatatgtatgtgattaggttacgctgcctgacaatggtggatgggaggtcccaaatcagtttgctgttgagttcatcaaaagggaagttctcttgggtgtgcctgacctaatcaggcaagacctttggttctgggcccttggtgaagtcccaatttgaggtgtaagaagttgtgctgctggccttgaagaagtgggctgccatgtggtgagatgcctctaagagctgagagcttccccacccacagcttgcaaggaagcagggctgagtcacacaacccccaaaatgaattctgccaacaacctgaaggagtttggaagtggatctttccctcgtaaagcttttggatgaagatgcttccagcctcaccaggatttcagcctgcagaccctgaggacaggacccaattaaaacactccagagtcccaacccttagaaactctgaaataataaggttgagctgtttgaacctgctatgcttgtggcaatttgccacataacaatagaaaactaatatatctagctaataacactaaaaaggaaaaataaaagaaagttataaacattggaaagaagaagcaaaatcattactatttgaaaataaagtgatcacctaattagaaaacccaaaggaattgattcagaagaataagaaaccataagaaaattcagtatgttacctggttacaaaatcaatatgttgaaaattataatactatatatagttgtcccttgaacaagaggggtgttaggggcaccaacctcctgtgcagtcaaaaatctatgtataacattttcactcctccaaaacttaactggtaatagtctgctgttgactggaagtcttaccaatcagataaacagttgattaacacacattcacattttggatgtcgtatgtactatatgctgtattcttacaataaagagaaaagaaaatgctattaagaaagtcataaggaagagaaaatatattttactattcattaagtggaagtggatcatcataaaggccttcatccttgtcatcttcttgttgagtaggctcaggaggaggaggaggaagaggagggctcagtcttgccatttcagggtggcagaggtggaagaaaatccacatataagtggacctatgctgtttaaacgcatgttgttcaaggtcaacaggatcaatatttattgtgccctgaatatatgccagatatacttactaagtttttatactttatcctgacaaccctaattagtatgtgtgactcttgtgcccgtgcacatatgtgaaaattaaagcacaaagagattaagtgacttgcccaacgttacaatgatgggcagggttaggacacaagctcttaaactatagacaaacagctttcctacatatgtgcaagcaaagactggttagaaaagagaatacaattaaaaattccatttataatggtaagcaaaaaggcagaatatcttagaatacacagatttaataagaggtgagcaggagcaatatcaaggaatccttaaacatctactggggaacctaaaagacttcatgactagatgggagggaaattcattttttaaacaaaaagactaaataatgtataagttccatgcaactctaattaaaataccaaaaaggggaaaagaaaatctacgcaataagaagtgctagggcaactggctagccacttggaaagaaatgaaacttaatctctacgtttcaacattaaaataaattccagagaaatcaaagagtaaaatataaattaaaacataaatatttgagaaatttgtaaaagaatcttgaagtaagccttttaaggcaccacacaattttaagacataatagaaacaattaataaatttaaaatgtatacgtttatggctaaaaaaacccacatttgtttgtggtaggaggaatctgtgttctcaatcccagggcctctctgcatctgcattagaagaacaagtctgtgcctttgacgtgtgaggtcggaggctcctgcagagtgggtggagtcccgtccccatcccagaataaacttggccatgggatatgcctggtggtgagtggaagtggcacatgccatcgccccgggccttctgatgcactacgtgctacctcttgccctcctccttgcccaggtggccactgccccttcaagcctgggccccggaatggacagatggcacagacacaaaccccatgagaagcttgcaacccaaagtggagccaccccagctgacctgcaaacccagaggagaaaataatggctcgctactgtcaagcactgcattttggtgtggtttttaatgtagcattattctgaaaagggccaatgaacacatttatggttaaaaaaaacccataaaaccaaaggctggtttcaaataggaaaaatatttataatacataaacagacaaaaggttttcttaatttacaaagagctcgtataaattaataaaagaaacaacagaaaaaaatggctgaatacgatgaataggatgtttagatttttaatgaacaataaacatgtaacagaatgcgtagacctactgaattttctaaagcaagtgaaaacaataagataagtatttttttcaacgagactggaaacattttggtgaagttttggtaaaacccagtgatggcaaagggcagaggggaaagaaagttcctcttaaacatttcttatgttggcataatttgatgtagccttccttgggaacaatttcatagcatctctcaaaataaaaactgtacatacccatactcaatggtttcaatcctgggaatttaacctgtggatatactaacagaaacaggccagcctatttacacaaggacgtttactacaaaaacctgaaccagtgagtagcaataaagggctagttaaaaagacttcggtatttacatagaacatgaatatgtgcattataaagtttgaggtagatctatttatgccactgtggaatgatctcgaagataaataactgacaagcaagacacagcccagtgtgcactgaaggatctctgtgtaaacaagaaggaatggatgaatgcatttactacataaacattgctctcttggaacgacgcacaagaaacctaacaatcggaaactagattaaggaggaggcgagggggaacttgcttttaaatgtgtaactttctgtaatattaacctttaatccatgcatgtattatgttaagcatatttaaaactctgcataccattgaacctagaattctacttctaagaattcccagtattaaccaaaggattatgtattttggaaactggaaacaaccgaggtgtgcagcaagagggaattacatatattcattgggtccttcctagttgctgccattaaatcatattatagaagaatatatatatatatacacacacatatatatgtatattgtattgtgtgtgtgtgtgtgtgtgtgtgtgtatatatgtatattggagacaaggtctccctctgtagcccaggctagaatgcagtggcatgatcacagctcactgtgacctccacctcccatgctcaagtgatcctcccatttcggcctcccgaatagcagggaatacaggcatgcatcacccggctgatttttgtatcttttgtagagagagggtttcactatgttgcccaggctggtctcgaactcctggctcaagtgatcccctcgctgtggcctcccaaagtgctgagattaaaggtgtgaaccactgtgcccagccacaggagaatatttaatgccatgtagaaacgttcacactaagtgaaagaagaagaaggaaaagcaggttgcaaaatggtgtggaaagtgcataatttcccttctgagaagcaaacaaatacataaagaaaatcagcagctgcatctcaaagttaccatggttatctccagacagtgagattttggcttcctctttatttttctgtttcccatggttgatacacaacagagaaaacgcactattaaaacccaagccagcgacagctggttctgcctcctaagtgaggaggcataacccatgccagtgggtactaactccctctaatgttcccatcagcaggcgggagaggtggacggggccagacaaattccaccacttcaatgtgagggccgatggcttcagaacaggtatggaaaggctctggaaacaatggcggccagtctgagtgagaggcagcaaaccagaatccctgcacagtgacggggtccaaggtggcaggatgaccaacaaggtgtgtaggggagggacggggcctgatctgcacagaaagtggttagccaggtggccatgtacacttctatgtgggctgctgctccttgatagagaataatgagaatttcagacataaatgcaagctacaagaataaattccaaccaggacccaaacgtattcaagagcctctgcccccctccctttctcaacccattgtcagaaaaaagtatgaagtgggaaggtagattgccctgcttgaaaaagagtattacataaaccatttgcaaatgacttttattctcttcttttagaaatctcctcatggcacaataataaaaacaatgtatttgttgatacagaacattaattccattaaaattgcattatgtgtaatgaaaagctatcagagtataattatgcaagcaaattcacagactcacatcaacttttaaatccactggaactatacaataggaactgaagctgtctggtagacaaattgctctttcttttccaaatcattatgaataaaggccactgtactaatgtcataaaccgcacactatttatgcaaactctcaaatccaggactgttccctagaggtgcctctgcctggtttttcccaggaccaacctgttctcagacccagaggctgtgctcccattcctgacttagccccaaagcaggctcccttctcggaattcttgcccagagagcccagttgtaccctgaagggagcctggttgcacccccaaagggttgcctgaatccgcacactctcagccctctgccccagcctgggagctgtgctctgctctgctgcccctggctggccgctgcagggcccgcaggctgctctccctcctccctgctgcaggtactgcacccaggtggccctcctgccatctctgctcacaccaggcagcgccacccacagagactggagtgcagagcccatctcctgtccccacgaggttctgagaggaggcagagggccaccaggacaggggaggaagggggcacgaggctggattcctgcaagggcacaggagtacatccagtgccgcccactcccgctgatgatagccccggtgaaaagacacaccctgggaaagggactcagtctatgcccctcactcatcacctatgtccatccctgggtttagacacttctaggatccccaaacacagtagggatatggacaactcgtgccatgctggtgacatgaagggaacccccccatctgactaagtggtcccagcacccttgtaatagccgtctccactccccagtcctgctcccctttcccctcactggcacaggcagaactcccctgtctggtcagttctgggtcgctgagtcccaggaacccccttcagcacccagcaggctgacactgatcttactcctgctttgcagaaggaacaccctcctgccttggccgcccccttgcttcctcccccactcacactccccagctgctcgttagtaagggctccctcggcccatcatctccccatacctcccctcccctcctcgcagtatctatcctgggagagcctgttccctccctggctccatcctccagggtaccctaagcctctctcagcctctcttcctcccagatccctgtgtccacccactggcctgatggaaacatgacggatgcctccccagcagcctaactcaatacagccagtgctcctggagcctgccctacctccacaggaggccccactcacccagatgtgcctgtcagggtcccagataccccacgtccctcccccacccaatctcactctcaaatccatccaaatcagggacatctactgaccagctcaccctgggccccggcccccagttcctccctccacctggtacctggctgccacctggcaggagagctactgtaagagccctacaaagccctccctgcctggactcctggtcacttctaacctgttttccacactgcagaatcatctttttaaaatgcaaacctggctgggcgtggtggctcacacctgtaatcccagcactttgggaggccgaggcgggcagatcacctgaggtcaggagttcgagaccagcctggccaacatggtgaaaccctgcctctactaaaactataaaaattagccaggcatggtggcatatgcctgtaatcccagctactcaggaggctgaggcaggtgaatcgtttgaacctgggaggtggaggttgcagtgagccaagattgcaccattgcactccagcctgggtgacagagcaagactccgtctccagaaaaaaaaaaaaaaaatctgaccatgtcactcgccccactcaatgacactgtgccctttaggggctttctttatcccttggagtaagtcccacatcttccagctcagaaggtccctgcctacccttcctgcttcatccaggtcactccatgggtggggtcacctctgcctccccctcaacccccaaacagctaattacccagactgggtagcaaacagctacaggaccacggggctacggcaccagcaccccacagtgccgctcactcatgcacctgcctttggctgctcagcaggtcctgggggcccagagcacgcttgtttcatctgcacagtgcccaccggagcaagggcctggtgccatggcacacatgagagtgaaggctgtcggcacgcacaaggttggccagcgcccacctccgggcgggagactttgtgcccatgctcctgaccagcttcacagccccacggaggcagcacggtcctgaggggcagtgtgctgacttttcccctttattttataaccaaaacaatgcaagttcaatatagaacaagttaggaaaggcagataagctgaaggaaataatgaaaccatctacattcacacggcttctcctctaactcctgttaacatgtggctgggttctatttaaatcggtttttataaaaattgggtcatcatgttgtcaataacctttccacattaccatataatgtgtcatgatcatgatggcacaccctgtaggtattcactgacatcaccttaatggctgaatgggactccattgtataaaaatacaaaatactcatgacctattattctataaacatttggaatcacaaacgtatgtgaaaaatatattttttaacaagcttatgaaaagataaacataagcctgtaatcccagcactttgggaggccaaggcgggtggatcacttgaggccaggagttcaagaccagtttggccaacatggcgaaaccgcatctctactaaaaatacaaaaaattagtcaagcatcatagcaggtgcctgtaatctcagctactcggatggctgaggtaagagaatcacttgaacctgggaggcaaaggttgcagtgagccaagatcatgccactgcactccagcctgggcgacagagcgaaactctgtttcaaaaattaaaaaaaagaatattaaaaaatatattaaatatatgaatatatttttaaaagtatttcattttttctgatctagtcattcttacacaatctgaagtcaaaattgttctgtagagaagctgccacttacaacaaatagttttgcttgtttcttcagtttactttcacatttctaaacttgatgctttgactgacttctgactatgaaaattgaggattctcactttcccctccaacacacagcagacacagccaaatgcacacactcgctctccctctcctcctcactttcccaatccaaatatagcaacaacccaccttttgatatttcagcattcagtattggcattattatgactacgtaaaatgtcacccataactgagccacaaggagtactacaattacagtgcctttaaaaaaaatcacatcacaatatgtaactggggttaattgcctcatttttcacttacatcttctacacagtcacacatgatttaacaacggagctatgttctgagaagtgcgcccttaggtgagtccatcattgtgtgaacctcacagaatgcacttacacaaacctagatggcgaagcccactacatacctaggctgtatggtacggcctactgctcccaggctacaaaactgggcagcatgttactgtcctgaacactgtaggcaactgtaatacaatggtgagtactttgtatttaacacatctcaacataataacggtacagtaaaaacatggtattagaatctcatgggaccaccattgtatacacagtccgtcattgagggaagcgttggtgtgtggtgtacgactgtatatctatcaaaaattcatcctagctctccaacagccctgaggtctccctcaccatgtatgagcacatgaagtctatcaaaaaatgagggagcaaaccaagaaaagagaagacatgggctcaagaaaacagaggctctagcccaggagagaggcgaaggggagtcgaagacccagggaagtccctaggagccatagtgcaccaggccagggcacagccaggtaaggagggagcaggtgacctgggtccaagaaggacatatctcagcaaaccagagtggtttgctccccatttttttgggttggggggagcccgagtctctctgtcacccatgctggagtgcagtggctcgatctccgctcactgcaacatacacctcccaatcaagcgattctcctgccgcagcctcccgagtagctgggactacaggcacccaccagcacaccccactaattttttggggttttttttgcatttttaatggagatagcgtttcaccatgttggccaggctggtctcgaactcctgacctccaggtgatccacccacctcggcctcccaaagtgctgggattacaggcctgagccactgcacctggcccacattttttgatagaccatatcctccactaactttcagagaaaggatttacagtaggtgaaatctgagggaccctacacgtttaacatgtaaggacagaaattttaggttgcagattattttgtctcagaactttttaggcaacgatctaatatgtgctgatctccatggtggctccagagtggtctgattcatcagcagatactggcaaggaccagctgtttaccaggcactgttctaggcacaggggatccagcagtttaaaaaaaagacatgcatagtgcctccctcatgacatcctggggagcagcagaggagggagacacaaaaataagagtgaaaccacatggcatgttacacagaatgaagaaaaataaggtgggaaagtgtgggctcaggagctgggaaatcctgggcttgtaggggtaacagatcccaaaaggaggaacgccctggtgggatggatgccggttcctgatggggatatacaggactctacaatggtgagacggtctttgtttttattcactgggtgaagtatgagaaactgatctgaatctgcaatctcctttcagttctgagaataactcctgtatcattttgcaatgatgattctacttcctttggtctctgcaaagcctatttatattctctggctgaccctctcatttactgtcttccctatttccaacttcctggtctttttttgttgttgttcagttttctgagagatttcccccaatttcatctttcaagcctttgatgatttttaaactttatattctgaaatttttcaaatagaaaagtacaaaaataagaatgttcaatccatctacttagcctgtcacgttaacaattttactatatttgcttcatctctttttctttgcttttcaagataaattacaaaccatgacattttaagtttttcaatatgcatacctaaaatacaaggacatttttctatataacctgtgaggccattaacacatctaaaatatactaattattaatagatcatctttgtatgatttcatacccaattcctattcaaatttcccagattgtccccagaataacttcttgcagttaatttgttcaaactagcttccaatgcttaggaatttgttatgtgcctacatggttgtaattttgttaagtagctttaaattttcagcttgttctttaacccacatgtctccggttttcagggtaggcaagggttttaatacaattatggtttcatcccttcacacatcccacatctctttctttgctagtataatctagaattttagattcaaactcatattacattgttttcatattatactcagtatcttttttcctttataaaaattaatttttcttttttttttggagatggagtctcgctttgttgcccaggcaatctcggctcactgcaacctccacctcctgagttcaagcaattctcatgcctcagcctcctgagtagctgggattacaagtagctgccaccacacccggctaatttttgtatttttagtagagacaggtttcaccatgttggccaggctggtctcgaactcctgacctcaagtgatctgcccaccttggcctcacaaagtgctgggattacaggcatgagccaccgtgcccggcctatttttctttttttttttttaaagacagggtctcaccgtgttacccaggctggtcttgaacaccctggctcaagtgatcctcctgccacaacctccgagtagctgggacttcaggcatgagccacctcgcctggctatattctgtgtctttcgatgttttttaaatttccactttccagttataactagtttcagtgttctgcattagttctgcttagccatgattccaccaactcaagctgctaacttaatagctcaaacgttgaatgacatcttcacgagactcctgtgagggtccccaaagcccccgatacctgagcatatcttcagggctcccaggaccaatatggactgctcgcctgctcagctatcatcacgtctgaagagcaggtcgccctagcgcaggtctggattcacagactttcccctcaatcactgcagatgctgcgtgcctgccctctgctttatcatagcagagaactctaaggcctgtctctttgtttgtatgtttgctttgctgaaaataaggtcccctacctagatgcttgtggaatcccattcttgaatttgcattgataatttcctttcctttctctctgaaacttttctggcatacttagttcatctccgcaagacagtgtgtttggtgttgcttgtttttgcactttacaaaaacagtgtcatagaaaaaacatagtattttttcatgtggtctcacaggcagagaactaattggctcctgcactgcaggtctcactcccctgcaggggctgctctggtggaagccagagcagggctgccccaggagcagccctggggcaacagagacttgaggcgacgggtctcggggaggcaagcctgaaatgtgctcggtaactgcactccagtcccctcaggagccagcacgatcacccgccgtagccaactgggtaacacacttggactagctatccttcctccctgcctccctctgccttcctgactgtgctctgcgcaaacaagagagattcctgctagtcctgctctcagtctgctttcagggtcatccaggctaagaacattcacgttcctaagattcctttatcatgttgttgcacacagctatagtttattcactttcactgtggtataacaacagtccatttcgttagaccacagaacttattttgtttgtttttgagatggagtcttgctctgttgcccaggctggagtgcagtggcacaatctcagctcactgcaacctccgcctcccaggttcaagcaattctcctgcctcagcctcccgagtagctgggattacaggcgtgcgccaccgcgcccagctaatttttttatttttagtagagacgtggtttcaccatgttggtcaggctggtctcgaattcctgacctggtgatccgccgcctcagcctcccaaactgctgagattacaggcatgagccactgcgcctggcctatataatttattaatatcccattcttctgctgatgaacatctgcactgtttccagtttttgctatcatgtactattcgttgatgactatcctggtgcacgtgggcaggagtttctgcaaggtatatgcttatgagtagaactgcaggtcacggtatgtgtgcatgttcagctatagaaaagaatgccaagttgtattccactgtattccagagtggtcccacccatttccactcccaccaagaattctcctgatccacattctgtccaaattggcattgtcaaacttcttaattgaggccaatctagtaggtgtaaacgatttctctccacagttgaattttacatgtccatgctgactggggcatgtgttgacacgtttattgaccctacatatgcccacttccatgaaatgcctatgtaagcattttgtccacttttctattgagttttgtgcctttatcctattgatttgtgggagttcactacatgaaatcataatcagttatgtgtattgcaagcatctccttccagttgtgtttttgctttcttcgtgatgtctttcaataaaaagaatgtttaaatgtacttacctttcaaacatatttttcagctttggcgtttctctgtcttgtttaaaaaattctttccaaatttcttacatcttacattttattctgtaaagttccaatgttttgctttcacagttaagtgtttaaaccacctgacactgattctcttgcatggatagccaatgatcccagaaccatttatggtagactccctgaattctgctcctggcctgccctgcatcgtttcatatatgcttcaggctctatcttatgttttgctgattgcattgtcttcctttgcacctacacttactgtctatagcttaaaaatgagtcttatacgtggtagcataaattccccccaaattcttcaggagcctcttgactttccttggcctatggctctgtcatataattttacaattaggttgttaagtcttaccctcccaacaaaaacatttgtcaggatttttaatgaaatcaattgaatctgatttggaaaaaaaaaacagccatcttcacagtattgagttagcttagactagctctctcaatatggtatatccctccatttatttaggttttatttaatgtctttcaataaagttttacacttttctgcatattcaaattacatattttttcttagatatagttctaagttccttatttttgtgctattgtaaataatgtccttaaacaatttacattttctctctgtggctgaagtataaagatacaattgatttttggtatattaaccttctagctaaccaccttgccaaactcattatttctaattgattgtagatggcttattcctgattttaaagggaatactttcaatgtttcctcattaagaataaaacagttctattaagtttgtatatgtattttttctataacttaagttctgttacgtttttctataaatctgtccattacatctgagttatcaaatgtgtagtctctcatcaactttttgatctcttctgtatctgtaattacatcttccttttcattcataataatggttatttgtaccttcttttttgttcttacacattcttaccatatttgtctattttgttagaattttcaaggagctaccttttggctatgtttatcctctttattgcagccttatattctatttcgttaatttctattcttatgtattatgttctttaaatttattcattcttctttttctaagtaaatctgatcacttcattcctattcttatgtattgtgttctttaaatttattcattcttctttttctaagtaaatctgatcacttcattcattttcaattgtcaatctttctaggtacctaaggctattcatttgcattacaatttcttctttgattaatgagttattaaaatctttttttaatttccaaatatattagggtcatttatccttttgttatttatttctaacttaattaaattgtggtcagagaatgtgatctccttgatattcattctttgaaatgttttgatatttactctacaaactaaaaaactgcaagatcaatttcttaaagatagtccctgtttacatgagaacatctctgaaagctgcagaattcagtatatgtaaattatacctggttgtgttctttaagttattacataatttttaattttctgtctgatagatcaacaatcaatatgtattgaaatttccttttcatgacagattgatcgatttctacctccatttttatgtgttttttctttatacgctttgcagtggtttaatcaaaagtatataagcataaaattgtacctatttgttatatgtaatgagcctctctctaacaaggctttttgactgaaagtcgattttgtctgatattaaaatggctctgccaatattcttttggttgacatctgcccacccaaacaactacacaaaaatctacaatttccaaactacattgtgaccagggttcattcatcacaacccctacatacgtacggtattttgcttgtgaactctcttcccctcttcctaccaaattttcttacagctttgaaatttgcctggacttcctaaaatgacaatgtcccagggaaatgttcaataatctgggtaaggagagacacacataggctcaaaataaagggatggaggaagatctaccaagcaaatggaaaacaaaaaaaggcaggggttgcaatcctggtctctaataaaacagactttaaaccaacaaagatcaaaagagacaaagaaggtcattacataatggtaaagggatcaatgcaacaagaagagctaactatcctaaatatatatgcacccaatacaggagcacccagattcataaagcaagtccttagtgacctacaaagagacttagactcccacacaataataatgggagactttaacaccccactgtcaacattagacagatcaacgagacagaaagttaacaaggatatccaggaattggactcagctctgcaccaagcggacctaatagacatctacagaactctccaccccaaatcaacagaatatatattcttttcagcaccataccacacctattccaaaattgaccacatagttggaagtaaagcactcctcagcaaatgtaaaagaacagaaattataaggaaccgtctctcagaccataatgcaatcaaactagaactcaggattaagaaactcactcaaaaccactcaactacatggaaactgaacaacctgctcctgaatgactactgggtacatcacgaaatgaaggcagaaataaagatgttctttgaaaccaacgagaacaaagatacaacataccagaatctctgggacacattcaaagcagtgtgtagagggaaatttatagcactaaatgcccacaagagaaagcaggaaagacctaaaattgacaccctaacatcacaattaaaagaactagagaagcaagagcaaacacattcaaaagctagcagaaggcaagaaataactaagatcagagcagaactgaaggagatagagacacaaaaacccttcaaaaaatcaatgaatccaggagctggttttctgaaaagatcaacaaaattgacagactgctagcaagactaataaagaagaaaagagagaagaatcaaatagatgcaataaaaaatgataaaggggatatcaccaccgatcccacagaaatacaaactaccatcagagaatactataaacacctctacacaaataaactagaaaatctagaagaaatggataaattcctcgacacatacaccctcccaagactaaaccaggaagaagttgaatctctgaatagacaaataataacaggctctgaaattgaggcaataattaatagcttaccaaccaaaaaaagtccaggaccagatggattcacagccgaattctaccagaggtacaaggaggagctggtaccattccttctgaaactattccaatcaacagaaaaacagtgaatcccccctaactcattttatgaggccagcatcatcctgatacaaagtctggcagagacacaacaaaaaaagagaattttacaccaatatccctgatgaacattgatgcaaaaatcctcaataaaatactggcaaaccgaatccagcagcacatcaaaaagcttatccaccatgatcaagtgggcttcatccctgggatgcaaggctggttcaacaagtgaaaatcaataaacgtaatccagcatataaacagaaccaaagacaaaaaccacgattatctcaatagatgcagaaaaggcctttgacagaattcaacaacccttcatgctaaaaactctcaataaattaggtattgatgggatgtatctcaaaataataagagctatctatgacaaacccacagccaatatcatactgaatgggcaaaaactggaagcattccctttgaaaactggcataagacagggatgccctctctcaccactcctattcaacatagtgttggaagttctggccagggcagtcaggcaggagaaggagataaacggcattcaattaggaaaagaggaagtcaaattgtccctgtttgcagatgacatgattgtatatctagaaaaccccgtcgtctcagcccacaatctccttaagctgataagcaacttcagcaaagtctcaggatacaaaatcaatgtgcaaaaatcacaagcattcttatacaccaataacagacagacagccaaatcatgagtgaactcccattcacaactgcttcaaagagaataaaatacctagaaatccaacttacaagggatgtgaaggacctcttcaaggacaactacaagccactgctcaatgaaataaaagaggatacaaacaaatggaagaacattccatgctcatgggtaggaagaatcagtatcgtgaaaatggccataatgcccaaggtaatttatagattcaatgccatccccatcaagctaccaatggctttcttcacagaattggaaaaaactactttaaagttcatatggaaccaaaaaagagcctgcattgccaagtcaatcctaagccaaaagaacaaagctggaggcatcacgctacctgacttcaaactatactacaaggctacagtaaccaaaacagcatggtactggtaccaaaacagagatatagaccaatggaatacaacagagccctcagaaataatgccgcgtatctacaaccatctgatctttgactaacctgacaaaaacgagaaatggggaaaggattccctatttaataaatggtgttgggaaaactggctagtcatatgcagaaagctgaaactggatctcttccttacaccttatacaaaaattaattcaaggtggattaaagacttacatgttagacctaaaaccataaaaaccctagaagaaaacctaggcaataccattcaggacataggcatgggcaaagacttcatgtctaaaacaccaaaagcaatggcaacaaaagccaaaattgacaaatgggatctaattaaactaaagagcttctgcacggcaaaagaaactaccatcagagtgaacaggcaacctacagaatgggagaaaatttttgcaatctactcatctgacaaagggctcatatccagaatctacaatgaactccaacaaatttacaagaagaaaacaaacaaccccatcaacaagtgggcaaaggatatgaacagacacttctcaaaagacatttatgcagccagaaaacacatgaaaaattgctcatcatcactggccatcagagaaatgcaaatcaaaaccacaatgagataccatctcacaccagttaggatggcgatcattaaaaagtcaggaaacaacaggtgctggagagggtgtggagaaataggaacactctttcactgttagtgggactgtaaaccagttcaaccattgtggaagtcagtgtggctattcctcagggatctagaactagaaatactatttgacccagccatcccattactgggtatatacccaaaggattataaatcatgctgctataaagacacatgcacacgtatgtttactgcagcactattcacaatagtaaagacttggaaccaacccaaatatccaacaatgatagactggattaagaaaatgtggcacatatacaccatggaatactatgcagccataaaaaatgatgagttcttgtcctttgtagggacatggatgaagctggaaaccatcattctcagcaaactatcgcaaggacaaaaaaccaaacaccgcatgttctcactcaggtgggaattgaacaatgagaacacatggacacagtaaggggaacatcacacaccggggactgctgtggggttaggggagcagagagagatagcattaggagatatatctaatgctgaatgacgagttaatgggtgcagcacaccaacatggcacatgtatacatatgtaacaaacctgcacgttgtgcacaggtaccctaaaacttaaagtataataataataaaatttaaaataataataataataatctacgtaaaaaaagaaatgttgatgtggctgaaatatatatgtatgtatcttgcaaatataattcatggctattttccatataaatcatctcaaatcaagatttgattttctctaacagatctggtctgaaaagtatagttatgaacaggagtggagtcatgggcattcactgcttctttaattgcattttctggaaaactctacagttctgtttttaacatttgatcacaccatcagtagagctacattccacaaagcaattatgttttgctcagcaaaatatcagaatggaataatatgctgcatattaacaactgtaagaatagaagccatttagaacattttagaataatgattgaggtcatttgttcagaatttacagcaaatgtgttttaaagacccactatcatggagtccactgtgaagtctaagttatgcacatcagaaactacaaatgcacaaggagcccagtattttatcaaaacattaatatcagcactattaaaaaccaaaccttttatccagcaccccctgcttaccagctctccccatgtacaaatgcattagcatttaatgcaatatgctttccttttctttaagggctttatccagatatctagaaagtagtaaagtggtagcatttaactaacacaggagtggcaaacaggtggcaactcccttcctcgacccagaaggacaaggctcatctatcaccacaccctccgtgcagagtacagaagccatcttagaatccttctaacacagtattccaggcaccatgacttagaatttgtgttggcatgccagatcccacctacccgaaggtgctatataaataggctagggcagctaggggaatacagttatatgtcttattcacaattctaaaaggcagttcgtggttgcacaggtctttcgcttccaggtcggatggagtagttagcagctcatcagtgtccccagtaagaacaacaggaaaagctcaataaaatatggaaatcaactctctgaaaatggctgagagtgacaaaattcaaacaggcttgagagaggaatgaacctccctccaagaagggagctaaactctgaagcttcttttatcctagaagtgttccaattctgggcacaagcagcagcctgagaactctggctatgcacctgctgaaagccagttctgggggaaaccccagcagggctatggttggagacttggggtccaagcacatggttgggttttcccctgggatagctttccaattctgagggtaagagacttaaattttaacaaaaagccactggaaggcagcctcaaaataaaaattgtaattaggaaacacaagagagaggggctgtgacaaatatagaagactctcatttgaaaaccctaaaaggcaaggacaaacaacagcaagactgaagcttaccagggctgcaaaccagctctgagtcagcacagtccttgcttcaatgaaggtgatgaacaccagataatctggacaataaagttagctggctgacttcaaaacaattatagttattacgcccaagaaaacagagaaaaagatgaataaaataaatgaaaagaagaatttcaccagataactataattggtaaaaattaataatcaaagagaaaatataaaactaaaaaatacaacatctaaaatgagtaactcaacagatgggtttaacagcaaattagatacagaagataagactagtaaacagcaagacaggtcaattaaaacgaatacccaaactaaaacctaaggaggaaaaaaaaatttaagaggattagagagacacaggacacaatgaatgggcctagtgtatgtgattcaagtcccattcagagaaaaagagaacagggtagaagaaatgatggccaaggattttctaaaacaaacaaaacagcaaatctcaaatcgttcagtaagcgctgcaaagctaagctggccatttacacaaaagaaaaagaaacctaaataaaaggaaaaatcttaaaagcagcaaaggagcagatctggacgcacatattaccttcaaagaagtaacaaaaagactggtagtcattttctaacaaaattgatggaaaccaccttttaagtcctgaaaggaagtagctgccaacctagaattctatcaccaagaaaatatccttcaaaaaaggaagctaaaataaaaatgtttctgagacaatcacagcagaatttgtcaccagcaaacttacactaaagaaaagaaaaatgacctagagaaaaacccaaataaggacgaagaaatgaagattgatgaaagggatgaatgaatatggactgcgaccaaactttggaagttatgaaaaggacagacaggcagtactgatttagccaaattaagaaagatggatcctaaagcagcaacagcagcagcagagaagagagaacaacccattgtgcacctcagaaccctcaaaagattcaggcacgagtctcaatgggcacctctggaagtggggctaatttggtgtagaaggcttgagggatttgggggctaatcaaggaagtagatatgctgaaaggaagcagtaacacatgcaagctttcttaaaaggttatgtgggaggggaagtccctcacagtatgacatccacaggcttcaagcaaggggtctatccagaaggggaagaggacaagggaactcctggggaaagggggtcagagaggaggctgacatagccaggtgacagtctgtagcagcacagcagggggtcccagggtcagagagctttgatggtagcagtggcttggagctttataaccacaaggctctatcttaccagaggccagctcaccgggtatgcaaagcagtcaggctcttaatggctaaaaatctgctaattcaggctatttgaaaaaaattagacgtgtaaaaatttgagtttggtaccagtgggcttctgagctaacagatctcagtctgctatgaagaaataaacaacctagaggccaatatatagtggccacctttggcctctatatgacacttgggaaggagggctaagataaggaatggaaatttggacagctacttgaaaacagatttcccagccctgcaccctagcagaattctgaaggactgttcccctaaaaacatcaaaacaggtctgtgctgtggactgaccagccccagaccacaatgcagcaacatgaggcaacagaaggcattctgaggctggtcccaccatgccctctgcccctgcagcatctttttaggtgaaactaatgcagaatgtgctccacaaaacaaggcagcaaagtcagaatgaggaagacctgagatgcagaaaatgacccagtggaattccagagatggcagaaagagggaacccgggctgacagctgtgtacaggcctagaaagccaccaacccaagagaagaaaatgagtcctggagaagaaaatgggaacagaaagataacctactagagctgagctgagtcagtattactgagaggctattgcaagaggagctattgattaaggcgaggcaagtactgacttcaagagtaagttagtgaaagtgaacataccactctacacagctctgcagtgaataatatctgcataggtataaatccaaatactgactaaattaaacttgtaacatacccactctggaggatgaggaaggggaaccagagagaaaatgaaaagctaaatcctcactgccataattagaaacctacaatgatatctacaaccaattaatcaaagatagcagaatttgtatcttatttagaaatgtggagacgtagtaagtcccagggaaaaaagctgaattaaaagtagttgcctctgcacaagttagagcagggaactactgggttttcctatttgctatttgactttttaaactatgttttcatttcattagatgacataaaaattaactttaaaaacacatagacatgaatatttttccttagtaatatgaaacttacaatgctcaaactacgtaacactagcatctataaaacctacaggaaaacagctgatcattttacatttaacttcttttaatataaagagagcttactctcctaaattaagccaaaactcccagatctctcaatttttcatggtgccatgggaaaaagcaaatctgatgtttctaccctcaaaataccaaaaggattaacatcagctaatttcttcaattatgacttcatgagtaacggactctaagtcctggacagcagccaacatcctgccagatgctaaagacagcatggtggaggcctgaaagagaactcagaatgaggacatggggccgggcacggtggctcacgcctgtaatcccagcactttgggaggccgaagcaggtggatcacctgaggtcaggagttcaaaaccagcctggccaacatggtggaaccctgtctgtactaaaaatacaaaaaatttagccatgcatggtggtgggcacctgtaatacctgttactctggaagctgaggcaggagaattgcttgaacccaggaagcagaggttgcagtgagccgaggtcgcgccattgcactccagcctgagcaacaagagtgaaactccgtgtcaaaaaaaaagaaaaaagaaaaaaagaaaaaaaagaatgaggacatggccactgactggtgctgagcaggttatctctcacccaggatggggaccccacataccattatctgctctcctgcctctccgggggctcagcaacactatggcagtggactttgaattacagagcagaaagaaaggttaaattcttggacttgaataaagagaacggcagggtaaactctaggagtttgtagggggaaagtcagcaagtttgcgtgttaaataagggtagagtacaagacaactatcccagtggctgtaaggccaaagaactctgaggctctgtaatgtcggaagttgctggctctctgctatgcaaggtaaccctacccccaccctctaccatctcacctacaaaatcatcagtaaatttatctggacaaagatacctttgtaagagtagaccagggtggagtgaaggtgacaaggactcacaaaggttttgagtgtgaaacttaggtaagagagaaagaacagtgctgagacagcccctgagcatgatggatccagggggatggaacttgtactccatggaattagaagtaagtatggagagagtttgggacattgtggccaatggaaccggtgtacctaagaaggctaggggatcaagatggaatctgagatgcagaatccaatgtataatttcgggataggtgagtgtgtctttaatgttttacaaaatattagtttatcaaagaacacatataaaaatgggttccacgtcaacgaggtctgaaaacatgacatagtatacccttttcatgcagagtcacggtgcacatgagaataacacagtcaagctaaaatgcacaccacaggaaagaaaatgcttcaaccctgaataaccccgcctgccccaaatgtgaccttggaatctttttaactcagaatacacatttaacatcttgtatacacagttgtttactatacatgttagtgaaaatgctggcataggaaattatagtgggaattcagagagagataagttagggtttttttccttcacaatgaaaattccttcttctgactatacatataaatagtacaccctaatgctgctaaatttagttaacatgaaaaattctagagaagaatgtaaaattcacccacaccaccatacacaaagataaaccaatggcaatgtttaaatgtattcatacctagattttttggtttacaaagtttatttgggccggcgcggtggctcacgtctgtaatcccagcacttcaggaggccaaggcgggcggatcacgcggtcaggagatcgagaccatcctggctaccacagtgaaaccccatctctactaaaaatacaaaaaaaaaaaaaaaaattagccggacgacgtggcgggcgcctgtagtcccagctacgccagaggctgaggcaggagaatggcgtgaacctgggaggcggaggctgcagtaagcagatatcgcgccactgcactccaacctgggcgacagcgagactccgtctcaaaaaaaaaatttgatttttttctaaggactccgttcacagtacacagtttttcctttaaaaatatatcacagacgtatgtggacacccatcctccaatgatgtacattcagactatctcaatgggaaaaaaaatgaggcttacattgtgtccgcaatttattcttccccgtgggttcttggtcttgctgacttcaggaatgaaggcgtggaccctcacggtgagtgtcacagctcttaaagatggtgtgtctagagtttgttctttcagatgcgtctggaactttttccttcccacgggtttgtgctctcactgacttcaggaaggaagctgcaaaccctcaatgtgagttatagctcataaaggtaatgcaaacccaaagagtgagcaacagcaagctttattgccaagagcagcaaaaatacaaaacctctgcactacctaagtggaccccatggggctcccaccgctgactgggtggcttttgttcccttatttggccccgcccacatcctgctgattggtccattttacagagcgttgattggtcccttttacagagtgctgattggtcccttttacagagtgctgattggtgtgtttttatagagtgccgattggtgcatttacaatcctttagctggacacaaaagttctccaaatccccacctgacccagaagcccaacttggcttcctcttttaatattgctattgactctattctgcccagtctgggtaggcgccaacctctcaggtgaaaggagcacaagagaaggtaaaggctgtcttgacctgtagtgacccaacaccaggtcatccacaacagggagaagaggtactgagaggggccctgcaaagtcctggtttatttattccgttggtaaccatgaggcagaggagacacaccaggcagtgccccaggaatcctcaagctcacagctttttcaacacatttccttttctttacaactggagtctttctgaaagttgtcttctgcacaaattgctaccaaaatcctcgccagtgtctctcccactgcaggcacaagaccagcaagccttatcatgtctgtgtctccaagtatcttgttcttgctgaccaagtcatggttttctaattctactgacacagtacattctatttccatcatcaaaacccatcagacagatgacagatctgcaaacaccataatggggtgattatacttttatgactagtttttgttgttgttgttttgtttttgttttttgagatggagtctcgctctgttgcccaggctggagtgcagtggcatgatctccactcactgcaagctccacctccagggttcacgccattctcctgcctcagcctcccaagtagctgggactacaggcacccaccaccacgtccaggttttttgtttttttttttgtattttttaatagacatggggtttcactgtgttagccaggatggtctcgatctcctgacctcatcatctgcctgcctcagcctcccaaagtgctgggattacaggctgagccaccacgcctggctttttatgactagttttaaatcttctttatcctgtttggagttatatttttgtattgcattctatttgatcatacgtggacagtcctactttcctttacttggccactgccagatagctctttgccaatgccctggtctgttattttaagctatttgtgtttgtttgtttgccaatagtatctatctgatttttgctttttaccccaatctaaaagtgctgtcttttaatagaggaaattaagtaacacctttagcgtggtagctaacataactgaattatttcctagcttatttactatatttccttaatttttgtttctctaattttcctgtcttttgctattttgttcaatttttgttgtttgctttttctaatgatttggaaattatatatcaattttctaaccaaaattttaaatctatgtttgaaattatatatctaataagtatatatcaatagcatagatatctatagtctctatgcaacatggcaaaattttctacctcaacctgcctcccagattttatcaaaacaaccacattagtgtcaacaattcaaacttaactttatgtttcattggtttaattgcttacttctgcagtatttataccaatgcttcctgtttatctttaataactaaatataattattaaatttatataattctataaattattgaatttatataattattacataaagataattgattattttaataattaaataattgatttattttaataacaagtaaaggtattaaatatttaataataattttcctcatttggcttgtgcactacaagtcatttcctttattcagaaatggtatgcagaaatttggagtccactgtatttctgaaaatcactttcatgtacccattcacatacatgagcttagaaatcttgcatacagaaagcctagaggaatcttgcttaacaacctgttccttctaaaatatgcaaatgttgctgcattatcttctagcatttgactttatggattaaaatctagtattaatgtgattattttctgtagcctgctttgtcttgtttaacgcttatctttgattttttttgattactgaaattcagaaaatgttctattacatgaatcaaacctaaaacaaaaacatctcctatatgcctgtctgacgtcttacatgtatcttccatgacctttagcttttctctcctaatttccccatcttgtctcattcctctcagttgaaaaatagatcccccaggtgatatcctaattcactaatccaatgttggtcatctggtttccttctcacagtaacattttcgtgtcctccgtctgcctccactgcacttgacagtctcttcttttgcaatgtggcacctctcagatctcacaggtcataagccagagttgttttgaagttttattccatttctctgtttcactgtgtgccatttactccattggcttttggagttggtatgtgatatatcctaaacattcacaaatacttcaaaatgctatgcacactgggcgccgagtggtcagtgtgatgcccaaagcttggggcagtgcattacatacagaagtagaagagaattgtccaatcagaattaaacatgatggctttgacctactgtctgcaggaaataagtgatgagagaaggccaaagaaaactgtagccatgtggcctccagatggaccttattatcttatgggtgcttggtttctttttgttctttgaccctaggtgatttattttgttatatttaaagcaaactagcaatttctgctctataattaaaagtatgtgtatgtctttataaacactgagtatatatactattaattgctgttgttatttttccattctcaaagctttccaggcctaatcgttatcctgcaacaactttcaaagaagtgagagcaatgatttcctctcctccactgttcatacgaatcatggagaagcggggttgaaaacgaagactgcctgagccccaacccccggagtccaacttggggtacctgagatatagccctatctgttagtttcctattgctgctgcaaccaatgaccaaaaactcagtggcttaaaacaatacaaaattatcacctttcagcttttgaggtcaaaagtccaaaatgggttgggttggtaggactgagctccttctggaagctccaggggagagtccctttccttgccttctccagcttccagagactgccctcagcccttggcttgtggccccactgcactcctgagttctgcttccatcctcgcctctccttctctgactctcctgcctccctctttcccttatgagggcccttgtgactaccttgaacccattcagatacccggcataacctccccatctccaaacccataacttcaccacatctacaaagccccttttgccatgtaaagtaatacattcataggttccagcgattaggaaggacgtggacatcagtggggttgggggtacgagtctccctatacacccagaaacctgcactttgaacaagaaccagcagactgcctggtgagaaacaccaaatcacacccactacatggtggctggagctttttcctttaggacactcttcagacccatcaccttaaaagtccgaaaccaacagagtgataaatatcataatataaacaaaacaccatccttgacaatttattaagataaaatattgcagtatgtacctagacctacccagaattcatttttaagtggaaagttaaatgacagaacagaaatgtctaagaatcattggggaaaaatacaagtcaaacccaaagccaagtccactttccacagcagaatcaagatgacaccctgtggagactccgatacactcaaaaaacatacttccatgtttgtttgtttgagacagagtctcactctatcgcccaggctgcagtgaagtggttcgatcttggctcactgcaaccgctgccccatgggttcaagcgattctcctgcttcagcctcccgagtagctgttattacaggtgctcgccaccacacacggctatttttttggatttttagcagagatggggtttcaccatgttgaccaggctggtcttgaactcctgacctcaggtgatccaccctccttgcactcccaaagtgctgggattacaggtgtgagccaccgtgcccagccacttccatgttttaaagcttcacttttccatctgtcttaagctcttttcccaaaaaaaaaaaagtaaaatttctgaattgtttaaatacattattaggaaacagaacttaaaaggccagtcctcttagtacatgcccaaattccaaatgtgtcactatttctataataaatagcgccagcactgacagacttcataatgcagggtttcctgtgctgccattcaccagcacacacaaaagtgagagtaatgaaaatgtcaggaaacggcatcccatttagaaaccaggaaatacaaaaatgcagctatcagtcatccctaaggctggccaaataaaaggttttaaatatagtcacggatcaccagtgtcacaagcaacaacattcactgcacagagaggcagcagaatttgcagcattgaggatttgctgggtggctgatgagatctgcccactttgaacttgctctcaactgacatacccagatctatttttacattagctgtcaaaatgataggtctcctgcatcctatgcctgcactgttaattatctatctgcctatctgtctatccatccatccatccatcttgagatgtctatctatccatccgtccattcatctatcttgagatgtctatctgtccatccatccatccatccatcttgagatgtctatctatccatccatccatccatccatccatccatccatccatccatctatcttgagatggggtgttgctctgtggcccaagctggaatgcactggtgcgatcttggctcactgcagcctcaacctttcaggctccagcaatcctcctgccttagccccacaagtagctgggaccacaggcacacgctaccacacctgggtaattttaaaaattttgtagagacagagactcactacgttcccagggctggtctagaaattctggcctcaagcaatcctcccacctcggcctcctaaagtgctaggatcacgggcataagccaccatggccagccaatatttaatttttgaatttgggactcccacgttggagctgggattttgtacttacatgtatactctctagcacatgtaacccattaaaaacatcacctgctttgctggttgcagtccttcctcccctctgtcctaattctgacaggatccggtagaagggacaaattcgtctgtggttgaaatctacggacagccatgagctgaaactacggaccccgtagttctcaaaggaatacagagaagcaggtatggaatgccaacagggctgtgcaatgcccgatccgggccggcgtgagggcacctccatgatggggtgaggatgagggaaggagtcccagttcaagaagccgttaccaaaaggcactcctagcgagccaggtggcttcattcatccacgcctgatgtaaagccacccacataccccatctatacaatagggctgggcgcagactttcaaatacctattgaacctttacttcctctgaaacccagaagcctgtgttacagacctcaaccaccacatacacattgtctctaaggagaaatcaattccgtggggaaaacctgggaatggaggaagcggaaacaagaaagtgggaagtggggaaaggcaagaaggctttctttcagaaggtgagttagagataccacctgtctcccccattgataaaaggctcctcccatggctggctccactcatcctgccagcctcatttcaaaggccacaggctcagagaggtccctgctgagccccgagtccacagcacagccctggcccctctcgatggccttgcagttttatcttaaacatgtatctctgtatgaaatggtttccttattttttgcctgtctctcctgctctaggacgtgtactcgccaggcagaggcctggtgtgtcttctccaaagcagtatctccagctcccagcacaggcctggcccatagcagggactatgatcattatgaatgcattgagaagccaggcatggtggcacatgcctgtaatcacagctactcgggaggctaaggcaggagaatcacttgaacccgggaggcaagcagaggttgcagtgagccaaggtcatgccactgcactcccgcctgggcaacagagtgagactccatctcaaaaacaaacaaacaaacaaacaaaaagaatgcattgagagatgggtgggggaaggatgggaggaaggagggaggaatggaggtacacccatcactcggtaaaacaaggcctaatctgacctagatttaattatcctggagaccacccactccccaaaaaagggccaatgaccactctgagtcggatggattgacataaggagagagaggcagtgtccaatgaaactgtgctagagatcctcatggtccccaggttcctggtcttactgacacggctccggtgagctcccaccctcccagatgtctttctagtaactcctttgtgcgtagctacccaaagctggtttctgctgcttgccctaaatataccccattccaggagcatgtattcagggtggctgaggcacactgcgggcccaaactgttttcaagctttacatctgggcactctacctgtttaatcctcacaaggacctaaagagggaaatgcaattataatctggtattctaaggataccagtggccgggttacgtaaccccgggtaaaatcacgctggcagtaacaggggagcctcggtttatacccaggccataaatttccctcctgcgatgccacgctggcccctgcacgtatggtttattgtgataagtaaagaatcctatataacttatggtttttatgaatctaaaattttgatgaaacaggtctgcttggagtaggatccagctgtgtcattttgaatcttgtacaactgttagactgctttgagtcattctcctaaaactgtaattttattttaaattatatttaaattaattaaaaatataattttataacttgccccggagacattttacagacatgcttttagcaaaaatataacccacaaaataaaagttactttgtgaaaccctctcccaaaatttatataacatatataaccatttttcttaaaattatttttagatctaagcaatggtaaactcattagtctgttcataatatgattttatactccctggcatctgcaagcacagaacatagagaactcagcttgaggaaaaacagtaagcaaattaaaaagtaaaataaatcttagcctatgttcacacactcaaaatttaaataacagtttttctaggggaaaggagtgggaggtggaggcagagagatcaatccatttgcctctcactccaggtctgagaaccctcattttctattcttcaaattaatgaaatgaacacaagaccactctgatgaggaagtctgaaataatggaaacgccgtggcatttgcattccctttcaatgtgaacaggctattttgatagttagcaaaaccaggacaaattgcctgagatttcatcctttgttgctctaaaatggctctcgggctgtaataggccatatcactgcaaaatgcacttacctttaaataggcaggcaaagtggattgtgttaaatataaaattagtgacatgttctctcaactcatggagtctaattctaattcaaaagacttctgctcacttcagacaatgcctgttccttcttgtttataacctcaattccaattttctgcaattcaaataaatcccacctacagccctgggctttggtctcacccacctctgccccagacaccaggctcagactcccaggccctctgtctgccccgcacgcctgccatgtctgagctcttgagcatgggtctgtactgcctaggaggctcttcaccaggtttccacatcacggatgcctcgtcaccatcctggcctgggcttaaacgtcatctcctcccagtggcttggcctgaagaactgctctgatgtcttcttccccacatttgcaccatgtttgatcatcttactctggctggttagtgctgttcccatcagaccctctccccaacactgtaagctttgctgggatcaggaccctgggtccccagtgcacactgggggaatccggctgcagctggtgactcaggctgcaggagcccatgcccagggcagtgcccctgaccagtggctagaaacagcatggcagcccacacctacagggcctggcagacacctctgtcccagcatagcttcacccctcccctcctcccccagctccctgctgcagcctccccagaccctgagatccacgcagctgtgaggagccctcagctctccctgcaggcctggagttggccggctccactgctggtccagccctggctcctgcctccagcctcactcctgggcatctacccccaacaggcaccgggtataatcacctattctctacctgctcatcgcacgcccacctccatctgcaggtctttatcatggtgtaaggctcccctgggtaaagttctccatgagcataagaggcatcttttttacaactgaatcccagcacaaacaggtctcaatcacaccactgccctctcatgagccaaggaacctgcctgggccagcccccgacggtcctggcactctgtgtactggacccagccccagcactggtggctgtgactgtctcctccccacagcatcacaggtgggtgagtgtctagcctaggagggtaggtctcagccaacctcagttcactgtgtcttcaggttgcattttcattgtagtgaatactcagaatggaataatgcaatgaagggctgtgtcctgtttcaaatggaccacaggtgccccttcccagtttgctcctttcctttttgaactaatggtagaaaattccctttacccttagaaactcaactccaacagtgatttagctacattttattcttaaggctgctcatagtaattcacatatccatgagagaaagaccaatttacttaatggtacaaatcttattccccatcacataacacagctggtcaaaaatgcattctttcaagccaagatgaaataattcccagaatgtcccttttagtcaaatttggctcttgacaagtctagagagaatccccataataggcttcaaaggctggccccacagcccccactggcagctggtagggattcccagtaggggaagcctccccagaccccttctctgctactggctgtccctcaaggggtctcaaggtctctcagacaccaaacacagactcctccatgggaaaaaaaaaaaaaaaaaacagctaccttctggccctaggatctgtgcattctcctttcctaaagcgaaccaccctcatcctctcataaagaaccaaaaagcacgtcattcacctgatggctctacaccaccaaccctgttactctattcccatgccctgcttctatgtatttgttgctgtaagacttcttactacccagcattacattgtcaatttgtttgtctgtctaccctctgtctatcctagagaatgtgagcttagagtgtacaacagtacctagaaacggatgaccaaggaaatctgctgaatgaactaacgactgtgtggttaccgtggctctagctggcatgccactttaggatatatcttgagttttaggaattcaggaattcctgcaatctttcaaagggatcatggggcttccctgattgcagaattcagcaatctatgagcgagtatctatgcatttcattgcctctgctttggaagagactgttgttctgtaataggtctggtattcattaagcctttcaaaaagatgttccctggtgcataggtcaacattgcaaagtgtttccttcgccttcctaaacaagcctcacataagaagctatgtgattactggatgtttgggtgattaaaaccacatccttgcctttcctcagcatcccttcacctgttcagtgtcccacactaatccacagctgtgcaatgtatcataaatcagactcagagtctctggaagggtcatgtgctgcaaattacagaatacccagatcacacagacacatccacatggtgcaaaataaaccatgaaggagaaaagaatctcactctcgcaggtttgacctgaagcatacatgacatacatacatagagcacacatgaataaccaaactacttccactggagttaaaccttacagctcatccatgctcctcaagcagagatcagaggacactggggcagggcagggcggtggcagtgcacatggagtctcacgaagcttgagaaacaatgccttagacggtgaaaaaagtcttgtgttaaaaactaacatttcaaaatggaattttggtaaaacaatcaagaagaaagcatggcagaccatggcccgagtgttaggcagactccaagactcgagtttctcaaaatgggagtttgtggctcccagggaatctcagctatgatccaggttgagaaactgctctaaacccagtgagacttgtttcctgcaactatttaactgtggtctgttttgagagtactgtacacctgttttcctttcctccccattttcccctcttccctatcactctccaggctgcgccctactaactccatcctgcttgacaaacgtgtttgcttctttcagtgacttttccctcccattttcttttttggaaagtctgcctttgtctggcatttgtgtttttaagacagcaagaaacgtgagctcagagatctgcatccactctgtgctccccactggctccggggtgggagcagtcttcccagtctgcaaaccctcaaaggggaagtaatataaatttcaaatgaggacaccctcctaaagaagcagctggacccacattttggtacatctgcctggcactcccaggaatgagcagtggggaccatgtttgaccagcatagtgcatcctgggtgatgcttggggcaaattttcagcactgcttgtttaatttttatgtttgttaatatcctttttaggggatgataaaacttacccaagccttcaaaccatctttatagtgtagttttataaattgttatttggttctaatcaaactctgtgggagggaaaggtggacataaaaataaggcccttggattctttcaagagaatgttgctgcatatatatatacacatatatatacacacatatatatgtatatatatacaatatgtgtgtgtgtgtgtatatatatacacacacaaaatgtaaatggaactctaaagatgctctttcactgtggttgaaagtaagtatcacatctgggtaagcaactcatcccagtttgccctggagttttcggttttagtgctggaagatggaagacctccatcctgggaagtccctcaggcctggttgctcatgctatttttatgaaacatgacagcagagcacaggcatctactgagggaaccattaagccctttgctactgatgagtcaaccgatgtactagagcagccaatggcaacaaagctagatctgggatctgggcaaagtagaactcaggtgtacaaggaatgatcctatctggtgatttcactcctggggtgagaacatgcagagttcctgccattccatcgggcagttcagatgtcggagatcttgccatttgtcattttctctacaatgtcaggaatcatattgtaaaacacctgacactgacctggagaagaaaaatgtagctgtttaattcatgtgtaacatactcagattatcttatatgttagcaatactccattaggtctcgtctacctgcaaagagccctgggtcccatcgctgaggaagcgcctctactcaccctccagaggacatggacttcctgaaggaaaacagcactgcccatctggcactggggtcaatcgtttttaaactttaagagaactttttattccccaaagacattcctatgcagaatctaatatataaaacagacaaaagtggtgttctgtgagcagagatttcttttataagttcagatgtaaaatatgtattacatattcagtcgagaacaaaaaggttggaaactggcattatagagggcagctgaagtcataacagcctacaaaaatcatctacttctaaatttaattttggctgcccagtatcaagaaaattctggaaacaggttttactttgtaattttaggataccctcaaatgaaatgcattcggaagcttgaaaacaaaatgcaagggaacactgatgccaatgctgaatcatgaagagaaaccaataaatgacttctccactcgtttaagtattaattacttgggagaaaatgtttttcaaacgtatctgtaacattacggaatttccaacgatgttatattttgaaatatcaatccagtctttagacagaatttcaaacggtcatatttactttgttttccatgctgacccctaacctcctgtccaagaactcagaaggcccaaaaagatcaaatggacaggaggtgggggccaaacaaaaatgacaatacaacttcctgcttcaatcttaaattgtcttttagacgttacattccacttcattagttatccgaaaccaaagtccatgaagctgtccctgacttttcctatcccttccgaacatctcccactagtgcaaaaggccagggaagaatcaggtcattgaaaagaaatgatggctttttccagtaaacaatgatttcttaaagcctaaagtctacaatggactataaagctttccctatcaagtacataagccaaaggctcacatttaaagaaaaaaaacataactgcaatattgttgcaactagctataaaatgtaaaaatttaaaaagtaaacgtctaaattactaaaataagctgatatttagattctaagaggagatcagtaaccatgctcaagatgatcctaaaaacactgtcttctattaattggcctgttttaaaagtaacagaacacttcatataatattgcatctccaacttctattcttattcaccattctgaaactagactgagaggttggataattaataaaatcacccctttcccctggctcttgattatccttcatcagggtcatgtttgtacttctcttgtcgattgtaatcatttatttgaaacagtgtctcagcagttcattagcttttcattagtgcctgtaggttggataaaatgtgcttgaatttccaaagtaaatgcaaatccccttggtaatccagcaaggacatgaattcccagaacattttcaagtaagacagctccaatcagaacttggattttagtgaaaaaagtggtgtcctcctgaatggcagagaacccacgctcccatccagtcctaaacatcaattctgaaaatgaccatcacagtttggcttcatcttcaacctgaccgtggtattcaggaatgtcagttacttaattacaaacaaggagggcaagtcaaaagaattcaacacaaattttaaaagccaatgtatcagctactcagtaagttaaaaatatggctgccaggaccccacctggacagtcaaactcagcagctccagccttgaacacaagagacctggatccgcatcctgcctccggccctgggcagctgtgtagacctacacatcacaagctgagcttggtgtctgtatcttcaaaaaaggaaagatgatccacagttctgagactgggatggagatcacagaaataatgaaggggaagtgccttgcactgtccccaacacatagcaggcctccacaaatgaccgctttacaaagatcacagatgcagcctccccagtgttaaagtatgtcctcagtggacagtcaaaatggactccccgtggctaactgacgtgtgcaaaacgaaagcagagccaggtggccatagttgggtgaggaaaaggtcatgttctctgtgttctcagaaatatattgtaaaagtgtcacaggacctccctttctaccatccagtcaaaccagttcctgttgtcagtgctgaaatagagtgtagctggaaatgccgcagctgaccacccagagaccccctgaggccagcccatgaagacagacttgtgatgtcctccttaaagaccatccaacccggcccctgtacctgaatccccagctatcctgtggtttgcacctttatgaccttctatccccagtctctccttggagtacatttttgttttttgctgaaggctgtctctcccaatcttcagattgcttttagaaaataaagttatccttttgcctccgcagatctcactggtcttttgttaacacccgtaagggaagatagaattgcaggactgaaatgcatgccatgagacagaggaacaggtcaaacaggttaaacagaaacacacatgaaacaaggttatgtactaaccagttgaggaaaatgaggccagaggcaacaggaacttaaccatgtacatgtgtatttcccctgaaggcaatggctcagtattcactaactgagtatccatgatgacttcataaaacaaaactgctgcaaatgatgagaactggcaatacatatatttcctagttctgtcccctaatagagcatagaagcaatgatacccaatagtaaggagctcaactagcaccctggttttctaataccaaggcttcagacgatccaatcactctgagctatgggaggacattctctgataaaaggagaaacacataagcagctgatggtaggggcagggaaagcatcagaatgtaagatgaaccaggagcatcttatagtgctagaaaattggaattacacacacacacacacacacacacacacacacacacacacacacacacaaacagtagagggtgggagaagatgaagcaggagccaaatggccaaaggtcaaataacttgagcaacaaaataaatacccacactattgaattacaacctaaaggccaaaataaatagacaggagtccatattaatgtcacaatgactaaattaacaatggaggaagagaccaattttccttaaaaaagaattccaaatcagaaatgtgaaaaacaaaggagggaaacagaaagtcacccccagaacaccagggtgattgctgctgggcccagatccactctagaatgctaacatcagtgcttgaaattttaagaagaaacaggacatttgcaaggcctggaagtatctcccccagaatatttattaatcactatggctttaactcacgtccactaattctttgacacgctctcccccaggaggcaaagcttaatcctcctcctcttgagtgtgggctgaacttagtgactggcttctaacaaggagtaagggaggggaaagatggtgacttcacagaggagacatctggcagacaccagcttggccaggtgatcaaggttaactcaccagtagtaagtcacatgttgacatcatgatatgatgtgatgaggggggtaccttacctctgtggtggtcttcctcatattcgtaactccagtctaacaatgagaaagcatcagacaaacccaaattgagggatattctacaaaatacctgatccatatacttcaaagtgtcaaggtcatgaaaaacaaggaaagactgagaaactgagattagaggagattcaagagatatgatgattaaatgaaacatggtaccctggataaaaagaccattagtagaaaaattggtgaaatcccaaaaaagtctgtagtttagttatttttagttttgacaaatgtatgatggttacatgagatgctgatttttgagcaactccccgcttctgtgttaaatgattaatacaggagtcccctcacttccttttcctgttctaatgccagataccagccaaagcacatcatttttgcatcatcctacatgtggggaaatattttttattctgcatatcatagaatagtatgcattgatcataaaattttctgcagtagacttgagttaacttttcacctataaaattacaaccctcactcgtttccaacattagcatgaagaaaatggttactcccaggtttccacatcttactggagaaaaccgcaattaatgtcaccacaaatatccagtttccaacgttagctcagctgccattctgtgtgttcctgttcctcaatcatactcaattcacctgtggttcccgtcctgcctctcaccacagggtcggctgggcccaggatgacaaggggcctccctgcctcttccactgtcaccatcctctgcctcagggctgccatcatcgctctccctccttttcctgaatcccagcaccactggctcctccagggcccgctccaggggttatcccctcccctgcctccactctgtctctactcagtcctcccacccatgagcaaacacagccacactgtctccccatcccaaaaaagaacgttcctcagttcctcaaaacattaaacacagaatgaccatatgatccagcaattccacttctgggtatatacccaaaagaacaaaagaagggagaggcatgtgtacccccatgttcacggcagcattactcacaatagtgaaaaggtggaggcaaaccaagtgtccatccacaaatgcgtgcattgataaaatggagtccatccacacaatggagtgttattcagccttgaaaggaaattcagacacatgccacaacatggatggaccctgaggacactgtgctgagcaaaataagccgatcacaaaaggacaaatatgtgtgactccacttctgtgaggtacctacggtagtcaaattcttagagacaggaagtagagtggtggttgccagagcctggggagaggagggaatgtggaattcgtgttgaatggtgactggatacagagtttcagttggggaagatgaaaagcgttctgtggatggatggtggtagtcatacgaaggtgactaataatcccccaaatgcccaatcccatcacccattctcagaactccatggcatttgacactgctaaccaacttctacagcattaagcccgctgctccccagctctcgttctgcaattgttgagggacagttatgcgcacgtgtgtgtgtgtgagaatatacgttatgaattatactgggtgtgcatttatgtacatatatgcatatagacgatatttttttaattccacttactgaacatctactaccattatcagaaattacacaagtatttacatgcatcatcccatataatccccccaaattgccctgtattgcttcctgactccatctacaccatcaccagttttttcttggtttctttgctggcattgtcatatggtggagtccttggggttctgtccctcctcatctgcccaggtgagctcacgcactttcatagctcaccgccatctctgtggtgatggctctgagtcttcctttccagtccaggcccatctgctgagctccagacaccacacccatgtgtccacccaacatttcccatgagcctctcaaagtcaggacagccaataccaacccagttctctctccatccctccctcccaattcctctccagcatctatgctccttgttttataacctctgttgctgttgtccccctgaagcaccaagggaaaggaaaagcctcctcactgggattcctaatggaagcgtttgcacacagtgaccctcccagcacggaccccttgttaatagatgggtaggaagcaccaggaacagagtatgttcaaaatcagataagcgttataaaaactggtatggggtcagagtggagatcattttccaaaccaactattcgaaccaccccatcgccatctgggtaaagactgggttgtgcctccagcaagctactctgacttgggaagaccgtgtgcaactatctttgggaaacacagccgcatgctccttggctggaaatgatcagaggctctaaggagtgtaaaaagggaacacaaccctgattctaatttttattcttggagaaatcacgttttatttttcatatcaaagagggggaactctgtgggcagagtactctgccgagaaccagttctgttctgcaacttgtcccaatcatcaggaaaacacatgttccagggaagcccccatcagggcacacacagccccaaatcagggcatgctgtcacttcctctcattccctcgagagcccacctggccaaagaggctccagtggcctgattggagggcacatcaataatatggagggtccccgtgccccccgacctggaaagtcagcctcagcgatggggctctcggggcctcttaaaatgggaaaaacagaagatgaaaaggctgtttgcacttgtcagcaatgctggcactgctcactatccatactttaccctccccaattaaaaccacacacttgatctgttcacataacaaagcctcccttagagcccccagaggtgcctgctcccaaaacagcactgtcagggcacagcctcagtcctcactggacagaaaccaggggcagggaccaatcctctctctgtcccagccctttcaaaccaaagacagcgtctctgcgaaggagggaagccgcatgttttcatgctgagatacagtgcagatttatgatcggcacctgtgaggtcctcaggtacctcttgctggaacagagcaacaggtttctaaaggttctggcccttggcctctacatttgtcaccactcctgtggtcactcttcagtggaagttgctcaccagcctccttgtcccacatgtaaaagccaaaaggaggggccctacagcaccactgtcattggaatccttccaacattccccacccaccttatgcagtgggaagacaaggttcctaccagaccctccaaagcccaggaacctctccctgtgctgacatccaaagatgcccggcgttccaaaacaccagaaatccagggaagaggccctaccttggggatgagtacattaggaaatagccaaggagcaggattaagtaattatacactagcccaccaggaaaccatgacactgaacatcccatggggcccacgggtctggtgggtgtttctcgcccactgggggctggataagtgagcatgagggtgtgccccaagaagtgtccgaggcagagctcaatcctttagaggtttattttgccaaggttgggatgtacccaagcaaaagaaacacaagttacagtagggtctgcggcctgggcttttctccaaagaggggtctgagaaagagcaagcaggaggggaaaaggagagaggggtgcccatgaggcaagtggttacatcctcggaggctttgattggcattcagtgaatctgcatcttacatataaaaagaaggggccgggcgcggtggctcacacctgtaatcccagcactttgggagggggaggcgggtggatcacaaggtcaggagatcgagaccatcctggctaacatggtgaaaccccatctctactaaaaatagaaaacattagccaggcgtgatggtgggcgcctgtagtcccagctactcaggaggctgaggcaggagaatggcgtgaacctgggaggtggagcttgcagtgagccgagatcgcgccactgcactccgcctgggcgacagagcaagactccgtctcaaaaagaaagaaagacagacagaaagaaagacagacagaaagaaagacagacagaaagaaagacagacaaagaaagaaagaaagaaagaaagaaagaaagaaagaaagaaagaaagaaagaaagaaagaaagaaagaaagaaagaaagagaaagagaaaagaaggggataggggaaaagccaagtatgcattcttctcaggctcagcaaatctacattttatataagcaagcatgtgaaatcacggctatccgttgcggggtgcgggataaaaaggaaagtggttttttgcatgactcagttctcaagcttaactttccctttggcatagtgagtctggggtccacagcttccttcttttttttctttttttcttttttttctttttttttttcttttctgtcacccaagctggagtgcagtggcttgatctcagctcactgcaaactccgactcccaggttcaagcgattctcctgcctcagcctcccgaatacctggcactacaggcgcccaccaccatgcctggctaatttttgtatttttagtagagacggggtttcaccatattggccaggctggtctcgaactcctgaccttgtgatccgcccacctcggcctcccaaagtgctgggattacaggtgtgagccatcacacctggccggcagatttcattttcctttcacaaatgcgtggtctactggacaagccctgagatgaagatggctagagaggctccacagtccctggaggggggcactggcaggcggtccacggccactcaggctgagaccctggctctagaaaagggaggaagtgcaggtaccaataaggtttaaggatggatgtatcagactgtggacaaagactaaaagaaacagggctgccagcccaatactgacaccttgcttcctcatagaatagcagatgtgttggggtggcaatgtgcccaactgctatggtctaaatgtttgggtccccccaaaattcctatgttgaaatcctaacacccaatgtgattgtattaggaggtggagcttttggaggtgatttggtgatgacggtggagccctcatgaatggaattagtgcgagatactgggatttacaagaagaaatatatatctgctcttcttgtttcctggcatgcagctcctaacacttggaatctccaaggtgatgtgtctttttgtgtgctaataagatgagtggtagtgaggggcttctggacagcctcaggatgggggctgattgccaagtgaaccaaccctgtgattagagcgttggaactttcaggcccacaatcccaccaccacccctcaccttagggaagggaagaggggccaaaggttgagttaatcacccaacaaccaatgatgtaatcaatcaagctatgcaatgatgcctccataaaaacctaaaataactggatttggagagcttccagttgctgagcacatggaggttcctggagggtggcgcccagagaaagctccacacccctttccacaaataagaggttaccctgtgcatctcctccatctggctgttcatctgtatcctttgtaatatcctttataataattgggtaaatgtaagcaagaatgtttccctgagttcttgagccatgccagccatcccactcctggagaagggagttgtgagaaccccaatttatagaccatcagtcagaggtacagatcacaacctgggatttgcaactgccatctagagtggaagcatctgagccctcaacctgtgggatctgatgcgaattccaggcagacagtgtcaggactgaactgacttagaggacacccagctgatgtctgctggagaattgcttgctgtatgggaaaacatcccacacacatctgggcgaccagagaagcattctaaattattgagagtgagggctggaaaaactgtgtttttctatatctcgaacagtgcccttataaattaagaggccgaagagagctagttcgccccttccaccaagtgaggacacagcaagaaggcatgatgcagaaggaagcaggccttcctcagacactgaatctgccagcaccttgatcttggacttctggctccagaactgtgagcaataaatgcctgttgtttttaagctaccgactctaaggcattttgttatagcaaccccacacggactaagacaccaactaacactcctttcccagaccacactggcttaggagtggccatgtgacccaattcagactaaagaggtgaggggggaagtctgctaggtggttcttggaaggtttttttttcctggaacaggttccccacgtttctgtttccaattcttgctgcctggaagacagacacgctacttggagaaatagaagccctgcagtaatcctgagacaatacgcacagagcaaagccaacatgccaaagttggccagcagaaaggaggaggagcctcggtccccagtggcaccatggggtggggagtgagatcatggctttttcttgatatacgtgtatactgtttcacctgtgcattagttttgtatggctgccacaacaaattacctcaaagtcagcagcttaaagcaacacaaatttatgatcttgcatttctgtaggttagaagtcccaaacaggtctccctgtggagactctagggctgaatccattatcctgccttttcccactcctagaggtgacccacattccttggttgtcagccaccttcctccattcctgacttccagagccaggagcatggtatctcttgagccattcttctgcagtcacacctccttctgattctcctcttctgcctccctcttccacttatgggactttctctcacccagataatccaggattacatcccttttcgaggtcaactgaccagcaatcttaattccatccacaaccttaattcccctttaccacataacctaacatgttccagggattaaggcatggacatctttgtggaggggggtcactattcagccaaccacaaattcttacagcaagcaaattccttttgttatttaaaacacaaatcaaataatttttaattaaaatattttaattgaatattaaaaattgggactgtaatccaataaatcaaaaaagaaagtccaacctttaaagcacaatgaatcaagaatgctaagatttccatggagaaaagaagtcattctgggattagatgagaacaggccccttctaccacctctgctgatcagtgggcatgcctttactcataaaaaacagagtacagggagctctgcatagcacagtcttcgccaggctgaggctgcttcccagctcctgtgtgtctgactgggctagtccttcacatcccatgcaaaaggttgaatttttttattttctttgagacagggtctcactctgttgcccaggctggagtgcagtggcacaatcgcagctcactgcagcttcaacctctgggcttaagccatcctcccacctcagcctcctgagtagctgggactacaggtgcatgccactgggactacaggtgcatgccaccagacctggctgatttttttttttttttcgtagagatgggggtctcgccatgttgcccaagctggtctcgaactcctgggcacaagtgaccttcccacctggctttgaatatttttaaatttactttaaaaaatgggcttggccgggcgtggtggctcacccctgtaatcccagcactttgggaggccaaggcaggtggattacctgaggtcaggagttcaagaccagcctggccaacatggtgaaactccgtctctgctaaaaatacaaaaaaaattagctgggcgtggtggcaagtgcctgtaatcccacctacttgggaggctaaggcaggagaatcacttgaacccgggacgtggaggctgcagtgagcgggattgagtgcactctagcactgcactctagcctgggtgatggagcgagactctctgtctcaaaaaaaaaagggcttaagcaatttccaattatttaaatttttttgaacttaataagcccaacaagatctttctcctttctaattaatgctaccaggtgagcatcttgaaaaacagtggcctataggtgggtcaccattctccgttgacacaagccctcctacaacagcacctcggggagggagcctcaatgggctccagtgcttcacctatgatgggattctgtggatttaaaacgaagacacaccactgaccttcaagaatctccctggcagatatctcccaaacattcagtcctgatacaagtatcttcataactggaattcacctacttccagaacgtcaggatgagtacccaggacagctctgactgcctgttgcttaaaaccatgcccaggtcataaagccctcactgtactgtaccctaaatgcacttaagcgactgttttctacagtgtcctagtactgaatgttgacactaacctatgaaactaagtgtcatacttactgtgaggcagagaaaccatcaactgaccacaaggtttgtttcaagaacaaatcgagacgaaccaataatgcagaggctaaatttttcaaatcaataataatacagttcacatgcaagagcttttgaaaactcttccatatgataaatatcacatcacatcggtagagatggaaattagattgctcaaccaggtgaatcaaatttaatccagctttttccatcctgttttctaaatatcttgtattattttaaattagttttgaaaaatcaatctgaaagtataaaagatacaaatgaaatctgggtcttggagcccctgggtctaggagcctgattccaagaacacatttcacctgcagctccaaccaggggtctcttcccaacccctggcctgaaggtctccagcctgggatggagcacctccttccttagaaacaaacactgttactgcatctacatgaaatggctcaaaagagttaagagagaatgttgcgatcactgaagaatggtctgaatgagaaagaaagagtagtggacatttaaagcttaattgccagactcagcttttcccttaatcagggaaactgacctaatgagaacagaggggtctctgtgaagctgccaagctcaaaggaggcaaggcagcataaagagacatctgaaggcaggtgtgacatccaaactaggagaagctcagagaaagaagcaaccagggacaggacaacctccatgaaacgatgtgtttgagctgaggtgctggccatggtgctgacaggggtcagcttggggaggcccagggaggtggaagatgaaggcttgatcactgactggatagaaagacagggacaggaagaagaaggagcttggcaggtgaagtgcaggcacaaatacctacccttctctgctttcggaatgtgatgaatgtgaatgatcaccctttatgtcctttataggacaaaaacctcagcagaataaataaccaacatgttagtcacactaaagaaccactctgaagcacagaagaataagcagagtaagatgaacaagacaaaaactttaatattaaagaagaaaatagaagtttgttacaacaaaattacaccaaacttgttaacagaacaatgtggcagcttaagactcaagactttatttttctcatcctcaaaggtccacttcatggttttaattagacaaacattttgtagagtactataattctctatcttttaaatacacattcacattatggtgaaattgggaaatcctaatatttacttgtattaagaagtgtttaagcagtccctttcctctacaaactcaccggtacctgttgttttttgactttttaatagaagccattctgactggtgtgatatggtatttcattgtgcttttgatttgcatttctctaatgataagtgatattgagcattttttcataggcttgttgactgcacgtatgtctttggaaaagtgtctgttcatgtcctttgcccactttttaatgagtttcttagttttttgcttgtacatttgtttaagttccttgtagattctgaatattggacctttgtcagatgcatagtttgcaaatattttctcccatcctgtaggctgcctgttttctctattgatagtttcttttctgtgcagaagctccttaattatgtaccatttgtcaatttttgcttttggtggtgttgtcatgaaatctttgccagtttccatgtccaaaatggtatttcctgggttatcttccagggtttttatagttttgggtttttacattttagtccttaatccatcttcagttgatttttgtatatggtgaagggaacgggcccagtttcagtcttctgcctatggttagccagctatcccggcaccatttattgaatagggagccctttccccactgcttgctttgcaggtgggggtgtaaattagttcaatcattgtggaaagcagtgtggcaattcctcaaagagctaaaaacagaattaccattcagcccagcaatcctagtactgaggataaacccaaaggaatataaatcattctatcataaagacacatgcatgcatatgctctctgcaacactattcacaatagcaaagacactgaatcaacctaaatgcccatcaatggtagactgggtaaagaaaatgtggtacatatacatcatggaatatgatgcggccattaaaaagaatgatgttcctgcaaaggaacatagatggccattatccttagcaaattaatgcaggaacagaaaaccaaatactgcatgttctcacttaaaagcgggagctaaacaatgagtacacatggacagaaagaggggaacaacagactctggggcctacttgagagaagagggtgggaggagagagagattcaggaaaaaaaaaaactgttgggtactatgcttagtactcaggtgaggaaataatctgtacaccaaacccccaagtcacgaatttacctgtataacaaacctgcactgaacctaaaataaaggttaaaaaaaaagaagtgttaacagctccaaataagtaagagtaactgtccactccctgcagttgttcccactgagcctctggtggccccaccccaatccctatggggtctagaaagagtgccccggtctccctggtccttcgctgatgatggggggtggcagctctctggccggccctcggccctcggccctcgcctctcgcctgttaggtaccctggacttctccacatccttccccaccccttctcgcctctcccacaggagtctgcaggaccaggccagcaggtggctcagctgagcatctgcagacacagcacaccgaccccacagagaaaaggcactcccagaccactgtcacagagagctcatgtcgggggcgcgaggggctgagaggggccagtcacaagtcaggcaagtccatacagggacacagagagcaggcagaggtcagggcagctgtggatgactcggggcgtgactgaaatgcatgaaaggatggttcaagaacagcccagcagctcccctctgcccaccacgggagggtcttcactatcagtgaggaattaagactgcaggcagcgaagccccctccccaccggaaccttgcagggctccctcgaggggccaccactcctatcacagccactgtcctgctcatcccagtgaccttaggggccccacccccctgcaagtcctgctcactggcaagcctagcttggaggcaacgctcggggcaaagccagagggtcctccccaggccttctgtgcagacctctgcgaagaatcctgctcagcagtagatatttattgtattttaatatcagggccaaaagctacagttcgcttttcagttaagtaaatgtgtattcactaaagggttttaaaacctttttcctgaaaaaaatgttctagaccatcaaatgcctttttatattgttaacttttactcatttaaaatgcatgttttctaagccacattttacacacttttctatatagacaactctcaattaattccctaagccaaacccagaaatgtttaacacacactttattgacactaaggcacaaatgatgagtggcctctagtgttacccacaaccatctgctttctcagcagcactggcacctggtgctgacagcccctcacccacccccatctcccattccccatcccagagcaggcaagaggggaagtggatattgggaatcctgagagagcagggatttggggcaagcagtaaccagagaagggaagccatagcccttcaccctcgtcagctcccagaagcctctgaaacaccaggaaggaggcctcatgccacatggtatggaatggggctcaactaatgtgatgtggcgaataagcagaacacgggctgcttggctgtttcatctgcttctgttttcttggtagtatctggcctatcagagacaattataccacaccacagtcacagtcctacctgcctctgagtcctaagtgcagattcttaagaagaacagacgggaatcctttagcgtcacagggtaggtgtgagtctgcgctccaggctccagagatgcttctgcaagcatgctgcccaaatccacgtcttttctgctactgggagctctctcatctttaaaatacagaatgcatttctcatatctgaaggaatatatttaactggtgtctcaacataacacttaaagcaaaacccaaaagcagagggtggggggttggggggagtaaagagcagccatatcccagtggaggggcaggaggaagagaaagaaggcctcaggagacctggtcaggccggctgagcggcaggggatgcaggacaagcaggcagaaatgagtggaaaagctgagagaggccgagaggaaattaaaccggaggaggcagagccaagtaacgagcaaacatgaaaggaaatgcctccctgcttcctgccctttctaaaatcacctcgaggcaactgaccacaaatagtcttctatcacaataaaaaaggagatcagaaatttcccggctgtttagtggcctgccaatgccacaccacagtcaccggccttcactgaacaccccggtgcagggggagagaatgtaataacttcttaagaatctgcacttaagcctcagaggccggtaggactgttactgtggtgcagtgatcacggtgctgcaaggcacggcaggacaatttcacagccctgtcctggaagtggcggaggggaggaggactgtgcctcacaagcagtgtactaacccagggatgaaaagcacacatttacttaactgaaaagtgaactgtagcttttggccctgatattaaaatacaataaatatctactgctgagcaggattcttcgcagaggtctgcacagaaggcctggggaggacctgctagctttgccccagcaaatacagagcatagacacccccaccggccagagtgccctgggctgggctgcacacttcctgttgatttcttgtccaattatctcaataatacatcctcaaggaaggaagtggagaacacacagaaaagaagaaaagaaataacgtatatcaccaccaggaaataaccactgctgctaatattttgatgtgtttccaatcagactttttttttgtacatgcacattgtacaaaattggaatcctactgtatagcaggaatcttgctgtgttcatttaaaataacatgagaccttctccaggccactgaatattctttgaaagcacggttttaatggccacagaatctgggaatgacatagtataaccaccctgctattattaagatattcaagctgcatccaattttcaactatgataagtaaagcttcagtgagtctctttacatacaaatgatactgacatctccgattttaatataaacccttagaaagaggatgattgagtcaaaggtcacaaacacttcttttccagaaggttccatcacttgacatttcctccactggagtatgagagtattcatcctccagcactcacccatactgagaataattatgagactgcaccagtttggtggacccaaaaacaaaaaagaattttttaaatttgcatttctctgattacttgtgaggtttggtacttttctatttgccttttatttttcttcagtgacttgccaactagagtccactgcagattttttccatttgatgttaatgttttcttattgatttatgactgcttttagtataatagggatggattggcaggtggacagcgtatgtcctgatttaccaattctgttgatgctgtttgacacacacaggatgctaatggatgtgtggtcaattgtatcaatctttccccttattatgacttccattgcaagtagagtgtcatggcccttcagcctgggatccagactcagctcccccactcactatctcagtgaccctctctttgcctcaatttccttgattgaacgtgcaggataatgagaatgcatttaatccatatagttagtatgtggcacacagcctcagagatggccccaatgccccccacctcctataatggcattcacatgtgatccctgcaggtccagccagcaggggccagggcctgcgaacagccacggagtgagcttggaggtagatactccccagtggtccctggagatgacgcagctccagccaacacttagtgagatcctcagccagaggcaacctgcaaagctgtgccaagattcctggcccacaaaactgggaagtaatacacattcgttgctgtaaactgctacatttaagggtgatttgctatgcagcaggagattactaatgcattatacacgtaaagcacttagaacagtggctgtggcagatcacacaaaaaaggcctaacacgttgacagtcctcccatggaaagaggaaatccgtctccacctggggtagctcagcttgactgtgtgatttgctctgaccaatggagctgtggcaaacgtgaagtcacctacacacaggagcctgcctcttacaactcctgaaactctgctgtctccatgtgaagaagcccagcctgctgggggatgagactacaaagcccatcacccctgctcaccccagtttacaggcagccatcctgacaatgcagcccatcacccctgcccgccccagcttacaggcaagccatactaaccatgtgaggccatcaatgcacgaccatgaatgagctcagcaaagagagccacccagccaagcccagcctgaatttccaacccaaatcacccactgagtaagtagttgctggtagaagccactatgttctggaatagtttgttacacagcatttgatacctaatacagctgccattattactactattattgtcttgggatcagttacatgatcatacatatttcttaacagtatatttatgcttttactttttaatccataggaaacttatttttgtgtatgatattaggtgaggacctaacaatgttttgccacacagccagttctcccttctccataaaactgcaacaccttgttttcacatattagaatccagagcaggggctcccaacccccaggccaccgaccagtatcagtccatggcctgttaggaatcaggccgcactgcaggaggtgagcagtgggcaagtgagcgaagcttcatctgtatttacagctgctccccactgcttgtgttaccacctgagctttgcctcctgtcagatcagcagcagcagcagattctcataggagcatgaaccctattgtaaactgtgcatgtaaaggatctaggttgtggctccttatgaaaagctaatgcctgatgatccgtcactatctcccatcatccccagatgaaactgtccagttgcaggaaaacaagctcagggctcccactgattctacattatggtgagttgcataattatttcattatatagtacaatgtaataataacagaaataaagtgtacaataaacgtaatgtgcttgaatcatcctgaaaccatccccaccccctccctgtccatggaaaaattgtcttccatgaaaccagtccctggtgcccaaaaggctggagactgctgatgtagagaatttggtgatatcatttccagtgatcatttctattggtatagtattaatagtaaatcttgacccaataccatacagctggtttgttttcattttgtcaggataatactgcatgttctttccactgaggcatggcaggagaaatgctcactaatctgactgcatggaagaggaggggtagtgaagttgctggggcaggtgcaggaggagagggagagcagcaacatgaatcaagagacagacacagtcacagtcaccaaagggatgggggtgacgtcaaggctattttttgtctgaaacagaaacaaaacctgccctaactttctaagtcagtcggctgccaaattccacaagctgattctgagcagggcactaggccctgtgaaggggttggcaaggtgcaaggagcatgtgggacagtgccccctcccaggtgttcacagccgcagaggggagacagtgccacctacgaaaccctggagaaaatatgtataaaccaagatgaacacaaattaatataatacaaataatatagaacggaaggagagcttagaagccccacaggtcaatcatggatggctacttggaggaaagttttcagatcctgaggagtaagatcagcaaagagtggtgtgtgcaaaggcaggaggctggaacacataattcatgtggactcatcagttacttggttagcgtaaaaagtctataaacaggtacactatgcagtgaggctgatgaaggcataggggccaatctgatggaagatcttcagtgttaggtctggtcttcaagagaaatgagcaaacaatgtgtgtttttaggtaataagagtaggaaactacaggttgtgcaccttcacagggccccgtgttcttgacacggttctgtgacatatgcagcattccccagtggctccagcagaaggaactgccttccctagaattctcaaaaaggagcacgacttcccaaaggaaaggaagcacagaagccggcatggttcccaggggaagatgcctgagaggccagccggaccccagccctctcacacatccagtcggaatgtccctgcccctgccatcacttggtgcagagcaggcatgggccagctaagaaaatgacgtctttgcttattttcaaattgtactgaataacagctttgagcctcaacgtttagaaatgaaaatacaagcatgagcaaggtcctagtctaaggatccatccacagctctcaggagagcaacatcttctgtgtcccttgcagagtcttccatggtgggaaggggctgcactgtgcaggaaggcaggccctggccctggtgcctgctggaaaggggcatcacgagagacaggtgctcggggcagaggctcagctgcagtcacagaagccctgaggcttggacagagcctgtcctgtcagcgctggcacccgctgccagggcccagttatactgcctgttcctttggctgtgttaatgagggcctaactagcagtggaggcctcacttccccatcagcatgaagctgctaagtgtcccccaaaacagtcgaaagtgtcacacgggagagacacactcgagagaaacttctgctgccccttgggttccagatttgcagtttgattttgcttgcctccatcaaggaccacacgaaccccaaattccaaataagaacactgcaggccagtgggaacctactgcctgtagcctgcaggatgaggcacggcttcctcacacccgaaccaagaggaccagctgtctcagcccacagagcccaggcctggcaaggagctggagcctgtatgagtcaggcctctccacagaaacaaaactgataggacacatatatcagaggaaattcattatgggaattggctcacacaattacagaagctgagaagtcttatgatctgctctctgcaagaggaagacccaggatagctagcatgtcggtcagtctgagtctaaaggcctgaggacagggtccaaaggcccaagaaccaggagcaccgatgtccgaaggcaggagaaaatgaatgtcccaactcaagtagagacagcaaatttgcccttcctgtgcctttttgatctatctgggccctccacagattggaggatgcatgcccaaactggcaagggcagatcttctttcctcagtctgctgattcaaatgtttatctcttcctgaaacaccctcacagacactatcaggaataatgttttaccagcacccctagcccaggcaaactgacacataaaattaaccatcgcagagccacgggcacggtagagaaggaaagcaatcctgagcccaccaagccccctacccaatccctccagctcttctcaaagcctccctgcccctcctcccaattttggagcttccgatccctgccctggacttggaggtgacccaggagtgatgcactagagataagccaaggtcatggtcacgcctcctctggatcctcagtcgacccaacttctccagcaccataatgtcaaacaatcatagctaatagtacatttttatatgaaaaaggaggattctctgctgaggataacacatgcttgaacacaaacgtttttttctggtttgtactcacgttcactttcagcagaatacgtctcctctgactcttcaggaaaccattccctttccttaatggggtagtattttttccacagactccttggtacattttctgtttgctttccctcacacaaaggagacttatccagagctaggacttgctaatggcaggcgtggattcagcaggtgtccggtgctgattcccacatgttcccaggcgcagagcaagaggaacagacccaatctccagggcaggcaaacttcaccaggccagctgccacacagggttgacaagggattgttctgcacccactgactctttctccgacccatccaatcaacaggggtcccaagaagctaagatttccattatttcctgctgcggggctcagccagcctcccgcaccactccatgcgtccccagccagactatcagtcctggtccttctgagcaacccagctgtttcttaagaatgcagtttcaaagagaccttcaaagatggggtgcaaggacagtcatctggcccatggcctgtggagaagtggcagctctatgaaatcgttggtgtgacatttcctgggagggtacatttcctgggaggagagatgagtcccatcatctgccctgaggacaggcactcttctctagggagcaatgtaagcaaggccagttccaccatcctcatagattatttctcacccttactgtaagaggtcctcaattctccagtcttcacaggtacagtagtttaatcaaactaggagttgtacatgatgttatataaagattatcgccaacagccagttattatccctaactccctcagagactaactacactgacattgagaaacgttaggtgactctgcagggttgtaagccaggagggagtgaagccaaggtttgcatagtgccttggccttctcctgtgagccccacatgcagcacaaacttggcccagaaagcccatggactcccttctcacactctatgtggggaatccaacctttgggaggtgactcttccattaacacagcttctaattcagttaattacttgacttgataggttagttccctttgttactacaaacaccactacctgcaagctatggtaatattatcatgcttcattaaaagttatcaagtgatctactttctaatagaggtataaacacctaaacacagctatttcaggccagatgaggtggcttacacctgaaatcctagcatttttggaggccaagacaggagggttgcttgagatgagaagttcaagaccagcctgggcaacacagcaagaccatgtcacaacaaaaaacattttttttttaatagctgggtgtggtggtgcacgcctgtagtcccagctactcaagatgctgaggcaagaggatcctgtgagcccaggagtttgaggctgcagtgagccacgatcgcaccactgccttccagcctgggtgacagagcaagactctatctcttaacaacaacaaagacagctatttcagactaagcctttaactttaaaaatatgaaacaatgtatgtgtcagttacgattcttaaatcattatgtctgcctgggtgcggtggctcatgcctgtaatcccgacactctggaaggccaaggtgggtggatcaccttgaggtcaggaattcgagatcagcctggccaacatagtgaaaccccatcactactaaaaatacaaaaattagcccggcacggtggcgcgtgcctgtattcccagctacttgggaggctgaggcaggagaatcacttgagcccggaggcggaggctgcagtgacccgagattgtgccactgcactccagcctgggcgacagagtgagactctgtctcaaaaaacaaaacaaaacaacaacaagaaaaaacacaattcttaaatcatcacatctaactggagtcaagtcattaacacatttgagaaatttagcaataacaaaaagattattaggattcttctaagctaacaattctaaattctaactacaaaaccaaatgttctggcttaccacaacagagaataacatccaagccactatcacgtcttttccaattagtaagccattggtggtgtgaataaaacctagaagtcaattttctacgaactctagcaggaagaaaagtgattcagctttacagttatcttctgacctgtttttagtcttcatgtaacaaaaagcttgtcaagttacaattttcttatagtgcctcactatagaacatttattctatacaaatgggattttctcaagacaataactacggcatcaacacgaggatgactgtaagacatcaatattttatctattttcatggatgttggacatgcccaacactatcccattttgtaaatgtattgccttgctctgtgtgatgtttgtgataaatgtagtgtcacagaaagcctccatgactgttatttcccttcattttataaatgccaagtttatttaaacctactgtcacatgactttgttaaccaaatacaactgttgaaactgttctaaaacaatgcttatatcagtatcaacacaccagaaaacatgagttgcttctcaaaaaaatttctgatggcccaaaatatcccaatattttgctcaagaaaggtaatttttcatttgatggtgttgatttttattatgataaaatacacagaaaataaaattttccattttcaccagttttttatttttttatcattttttgagacggagtcttgctctgtcgcccaggctagagagcagtggtgcgatcttggctcactgtaacctccgccttccaggttcaagcgattctccttactcagcctctcgagtagtacaggtgtctgccactgtgccaggctaatttttgtacttttggtagagctggggtttcactatcttggccctgctggtctggaactctcgaccttgtgatccacccgcttcggcctcccatagtgctgggattacaggcatgagccaccgtgcccggccatcattttcaccagtttttaagtgtatggttcagcagcattgagtacatttactgtgtttgcaaccatcaccaccacccatcttcagaacgtcttccaagactgaaactctgcacccactgaacaactccccattcctccctagccccgtccctggcaaccaccattctattttctgtctctgtgggtttgactactctatgtccctcatataaagtgaagtcatacagttattcgtccttttgtgactgacttatttcactcagcaccatgtcaaggttcatccatggtgcagcatgtgtcagaatctccttcctttttaaggctgagtaatgtttcatgacaggtgtaaaccacattctgtttacccattcttccatcaatggacgcttgggttgcttccatgttttagctattgtgaatcatgctgctatgaacatggctgtgcaaatatctctttgagcctctgctttccatcctttgagtatatacccagaagtgggattgctggatcacatggtaattctgttttaattttttgaggaaccactactctcctttgttcagtggctcacacctgtaatcccagcactttggaaggctgaggcgggcagatcaccttgggtcaggagtttgagaccagcctggctaacatggtgaaaccccgtttctactaaaaatacaaaaaattagccaggtgtggtgggccacacctgtaatgccagctactcgggaggctgaggcaagagaatcacttgaacccaggaggtggaggttgcagtgagccaaggtcgcaccactgcagtccagcttaggcaacaagagcgaaattcgatctcaaaactaataataataataataatacaattaaattcctcaagatgaaaagtggtggccaagtgtctggtgtactctgcaagttctgagaatcactaggagtcccatcacaaccttttcagcaaagcaatattctctctgggcatgacccctatgtccagaggacagtgtcaacccaaccaggctctgggcaggtggctgtagcttatcacagaaaaaagaaatcccaccagtgagaaccctctacaataaaatcagaaacagactcctaagatatgtagtttctactcctgttgatagtttttaaaaataatgaagggtaggaagttccagttaatagtgataactcgatcttgtgcacctacctctctcctgcctcctgaaaccttggacacactcggacaagaagatgaggaggtgcctccaggggcaggagagtccaacagccttttcaaagccttaacatggacataggaatggcgactgagatggcaggtacatggagggggagtgacgaggctcaggctgattcccctgcagaacttaggagcctgtgggttggagccactggggccccaggaggcaggctgcagagacacccaccaggctggaaaccaggggttggaaagaaggcttggcccaggcacttccacctgtctcatgaagcactgtgaccacacacctcagaggatactgaaacccagtccctggagaaagtatcaggaaaggttcagcggcccagggctgagttcagcaaccgatcttcaccaggtccaggggctgcttaggggatgggagttttctaaaactgggcatgtggctgcacaattatacaatgtattaaaaaatcattgagccgtagatttacaataggtgaataggacagtctgtaaattatacagcagcaaaactttaaaaatgcacagatgagagagagagacggaagtaaccaaaataccaaggaactatcaatgtggcaagtttttgatttttttttcctgctacccaacaaaatatgagtctgagaacaagataaggtgaattattttaaaaaataagaaatgatttccatgtgacacagcaattccacttctgggtacataccctaaataactgaaagcaggagctctaacagatatctgtgcacctatgttcacagcaggattactcacagtagctgcatggtggaaataacataagtgtccatcaatggcagaacagatatacaaaatgtggcacagacacaccatggaatattattttgctacaaaaaggagggaaatattgacacatgctccaacacggataaaccttgaggatgttacgctgagtgaaataagccagccatgaaacgacacatactgcaagatgccactcatatgagttgcccagagtcatcaaattcattgagatggaaaggagaataggggttccaggggccggggagaagggagatcatgttcaatggggacagttttagttgaggaagagggagtcttctggagatggattgcggtggtggctgcacagcaatgagaatgtacttactgccactgaaccgtactcttaaaaatggctaagacggtaaatgttatgttatagatatttcaccatgatactaaaaaaaaaagataaggaatgctatttttgcacagaaaagaataaagaaaagaaggacagctgagaaacgtggaagtgggtgtccctgcaactgggggcacctgcacagcatggggcaagaacagccactttcattaccagcttctcaacacaatttcactttgactctgttatatactagacagatttttaagcattaattttaaaacatgatggagagtggcggagatgaagagaaaatcaaatcatggaagctacacaccaataagcctgatgtcaatcacaggccagatctgagaggggactatcagagcagaaggctcgtgagtacttcaggaagcaagtgccaggccaaatgcatcttgatttctcttttaataaggttatgagattggcatattagagaaatgctgagcagatgagggcctttatttcagcaagaagttaacacagtcgctcgtggaccctatgaagaggaggcgatgtggaggggccccctgggcagggggcagcgaggccgctcatggcacaacctcggaaacagcaggagcagttggtccagccacagagctccggcccagcctggatgcaggacggggaacttgtttaaaacaggctgacaccatcgggcctgtaccctcagagacgagcctcccaatcaagatgagatcatctcaacaggctggaatgctaacttttaaagcgaacagatgaatttatcagtcttacaaatgttccgcaatttggtaccacaattcattaactgccatgagctgtaggacacagtggaaaggaaaaaagcatggggctttagaggaggagcagccccttcacctgaggcagtgacgatgcggttgggagctgcccaggccatagtggaaaccacccaatgtctgcccccgatataacccccactcagcactggtgccatgtccaaagtgacaagatgcccagaagccaccagatgaaaactgggtgaccagccttcaaatgtgcaagcagaaaaaagagctatgcagggaatggggtgcagaagtggttttctccatttgcagaacttcaatgttggaagggaagtaaggacatttcttggttctccaggaagagccaggcaaacagaatcattgtccaaaaatagatttggctctagttaaagctgcctgacaactgagccacgtgacactgcaagctccccatccccagctcagggaaacggagtgcccacacatcagaaatgccactgaaggactgtgcactctgcagaggattgacttaagtggaccataaacaccttctgataccctacagtaaaagagtaacagtgatgaaaataacaacttccatttgctaagtcctgaccgcagccaggcaatcctggatgtactctaaaggcttcctgactctgagtctttgattctcaaattgtatggtccattataaatacaatcaacaatcaaaccccaacataaagatatttaacataaatcattagttctttgggatgacagttataaataatttttataattctttaaaaggaagagtctatcaagtttataataaaaattgcctaacactaacatttaattagtcctaatacctgaccgacttcttctttcgagacatcagggtatacctaacaatgttcagatttgataaggtctcgaggaagcaggtagctcctttgtttgtggcctgagatctggcattgctgaagctagattgggccaggcctggctctgccaaatactgatgaactgccaggttcattcatttatccaacaaatatttactgagtgccagttatgtaccaggtgctgttctctgtaccggcagagagggcaaccagcccctgaagctggaagcatatggtttgaggatcaggaaaaccaagatgatggcatgatggagcgaggcatgagttcagcaggaagggccagtgagagcagctccgagcaacagtgcctcaaagggcaggttaaagaagaaaggaggggagagcaagaaagcagtgagagagactacacaagagaacaatgatgtctgctttatgtttctgtcatggtcactctggctgctgggtggagatggtcagcagagaagcaggaaagacagaaaagagaccagccagcaaggtagacactgcagcccccaggagagagcccaggagaggacgctgcagcccccaggggaggacactgctgcacccaggggagggcccaggtgaggatgctgatggccccaggggagggtccaggggaggatgctgcagccccctgggaagagccgaggagaggacgctgcacccccaagggagagcccaggggaggatgctgcagcccccaggggagagcccaggggaggatgctgcagcccccagggtagggcccaggggaggatgctgcagcccccaggggagggcccaggggaggatgctgcagcccccaggggagggcccggggaggatgctgatggccccaggggagggcccaggggtggatgctgcagcccccaggggagggcccaggagaggacgctgcagcccccaggagagggcccaggagaggacgctgcagcccccaggggagggcccaggggaggatgctgcagcccccaggggagggcccaggggaggatgctgcagcccccagggaagggcccaggggaagatgctgcagcccccagggtagggcccaggggaggatgctgcagcccccaggggagggcccaggggaggatgctgcagcccccaggggagggcccggggaggatgctgatggccccaggggagggcccaggggtggatgctgatggccccaggggagggcccaggggaggatgctgatggccccaggggagggcccaggggaggatgctgcagcccccaagtaaaactggagctcctccagaggaacagcagcaggggtggagggagggaatccagcctgggtgtgtcctgcggcaaagcgatgggcagggctaaaggaaaaggagaaatcgagatgcctctcaggctattggagtgaacaatggacaagaaaggaagccatgttttaaagatgtgcttaggtagtgttccacccaaagttcaaatccaagtcactgccaaaatgcaaaatgcaaactgccagacttgtggtctgttcatctatcagtaaacagggatgaataaaggcagaacatgcctgttcccttcagaaactaaatggctagaataaagtactgttccatttccagggtggctcagctaaaacgccaaggaaacggccacctgagtgttcgatgggaacacagtgtgagatgcaggttaagaggatgcttttgaaggctgcagtgctttgtggttgggctgtcctagttataggcccttccaaggctgtgtcaaagagattcaatgcacagagaccacccggtgaaactaccacatccccctgctttcatcacatcactccttagaggaacacacgttactctgaggaagttgaacatccgtagcccaattaagaccatctatggccaggcacagaaggcagtgtccagctctgttccccttccagactggcctttctgcagcatgacttaccagccttcaatcacactctgtttctgctcccctgtgcctaacttggggtacccacaacccactgcccttctctgttatccactggatgaaagccacccagcaatcatggctagctccagctctgcccctccctgaagcctcttctgattgttcctgcctccagatgccaaacaaaccgctgcctaaagaccttgcaccacagcacaaggctcacagctctttctcctgcaagtggatggtacgtgccggacagaagacaagctgcttgaaagcaagatcatcatgcattgtttttattcccccaaagaacctaggacagtgtttccaatactgggagcaccctccttccaacagtgatcgactgtaaagccataaatatttctaaatgtatactgaacataattaagaaattccaagacagcaaatattcattttataagctggttctgggggtgggatctaacttgcatcactagaccaccaatggtacctaaatgtgaatgattaagaaaagacaggctgggcatggtggctcatgcctgtaatcctagcactttgggaggccagggtgggcagatcacttgaggtccagagatcgagaccagcctggcgaacatagtgaaacctcgtctccactaaaaatacaaaaattaggcggggtggtggcgcatgcctgtaatcccagctacttgggaggctgaggcaggcgaatcgcttgaacccaggaggcagagattgcagtgagccgagattgccccattgtactccagcctgcgcaacgagagcaaaactccatctcaaaaaaaaaaaaaaaaagcaagacagataatccaaatgaacatttgcagggttgattaaactaattaaatctttaatagtgtctgaagttgcttttcaattattaatttggatgcatttttgttaaacttctgaatatgattttaaaatatagttctaatcattagccaacacatacatttttaacaattatatgataattaaatctgttttgaaactgttgaaaattttcttatgtaaccccagttttcagggcttcaagcaactgtggagctacaaaaaaaatatattaatatgattttttaaaaagttcttccaacgttaaggtaacacacacaaaacctgcacaaaggccaccagagcagccccatgcagccaaatgcagtggcctttcttccctagggctccggcttaggataaggctggaagagcatccgaggtggttccaccccatcccgatagcccccttccagaaatgctgacacatgcaacatccaccaatggatgaacctcgaggacatggtgctgagggaaatacgccagtcacagaggacaaatcctgcaagattctgcttcttttttgttttgttttgtttgtttgtttgtttgagacagagtttcgctctgtcgcccaggctggagtacagtggcgtgatctgggctcactgcaagctccgcctcttgggttcaagcaattctcctgcctcagcctcctgggtagctggaattacaggcgcacgccaccacgcccagctaatttttgtatttttagtagagacagggtttcaccatgttggccaggctggtctcgaactactgacctccagtgatccacctgccttggcctcccaaagtgctaggattacaggcatgagccaccactcccagccgcatgactgcacttctatgcagtacctggagtagtcagattcacagagaagtagagtggtggttgccatggcgggggaggggaaatagggagttggtgttgaatgactacagagtttcagcttgggaaggtgaaaacgttatagagatggatggtggtgatggctgagcaacagtgtgaacgcactcaatgccactgagttgtacacttcaacatggttaagaggatcagtttcacatatgtgtattttaccacaattaaacattttttaataaattaattttttttaaaaagcctcccttccagctccaaaggctacctttgagacagcctcctggaagggacccagcaggtcccccgtaagactctgattaaagttgtaaactgccacctccatatttctatctatagttgaattttctttaccactaaagaagtacttttgtctccttttccacattcagtgcccctgggtcatcaaaagtaagagctaaaagcactgattttttgacaagcaagccacagattcaatatcatgtatgttcaacacagccttgaaaaccgcagaatagatttctttaaatcactaaaaggagcctaagacaagatcaaagaatggatcccaaattaactgaaaaccttcacacacataccacagacagtcacggcgtgtgtgtgaacacgggcaggatccagcaaagccactcaagattggcagaggggctgctcggtgccccccactgccacgtttgttctatgtgtggttgagcatccggagggtcctgaggcagtgccagcccactgaggtcacaggtgaagcccacaggtcctgggccctgccaagggctacaggacactcatcaatcagcaggtgagagtacatttacctgcttcgtctcggggagcctcctgccagctcccttgcaaacttcattcacctcacgcctccctccttcctgccaagttcacctctgttgcaatccagggcaggcaaatactcgtcactcggacaaccagggcccatccttcaccgcggctgccgctactaatcaaccatatggtcttttccagggaagcccagacgcacttcgaaatccttcccagtcctacaaacgctgccggaagccacaatcaactgacaagcactggcagacaaggtgatgcgtgtgactcttccacagcatcctgacagtggccagctcggggctcatgagcctgaaggacgctctgccttcaagacgtctgacatgagacagtccctcaaagatatgctagccctgacagtgagcagttcctccttgattctcttcctagattaattttttgtttaattggtaattaatgttcattccttaataccaagtcacaattaaaaattgctcaagtcacagtcatttgacaaacgtcatgccttgtttcacattagcaaccactattacaggtgatctcactagaccaactcaaaatactggctatggctcgaagtgactctgctaagtaaacagaggtggggcattggaatcactccacattttcctgccgactcctgaattcattaagcagagctcagcccaatgcactggttttttatagtgccccacacagccccagaggatctaggggacattgatggtcctgggtggggagttgctaagtggagagggttgtaatgcctgggccccaccttcatccagatcaactccattttcacatactgagcttcctcataagatttcattggtagaaaaggctccatcactaagagtaaaaacgtttcccaactgttggctaatgcattgtgcagagagtgaatgtgcacatagaaaaagctccaagaaggacttctgaccacacagcggcccctcgagctgcaggggcagccagcatggactgggatgtgctacaaatagaaagtgagggcacaggtggctgagaataggcacaggagagaacagaaagacaagcacagaaaacagagagaccccgggaggcgccgggataacagagaggcagaacagcggctacaaagtggcaggaagggctggcagatccctaggaataaagggagtagcaaagctccaagcaaatgctcaccagagcccatatgcccatcataacccacacggcagcacgggggccaagggccacaaaaggcaatgcacgcatacaccggggtaatacgtaagccccgcacccgccagtaggacagcacacctctggtgcaaaggccctgggtgtttctttgaaaacaattagtcacactgatctacaacacattgtttctcaatcttttttctacctcatgccttcttctgaaaaagaagattctgaacaagctgcaggcagcccacatgcacacgtggagatttgggggccctgatccagcagccccgggagaatcagaacctgcagtccacatgcacaactctctgattcaagatcaatgctgacagtggtcacccaaggaggagtggccctgagggctggggtggagcagagggtggaacacagcagcacgcggtgggggcccagaagggctgggccaagcaacagggcagtgggcccccacaagctggggagaggagcaccccaaaacaatcttcccccaagaaatgcaaagcaggaatcatcatgaggcctcaatgtgctcatgttacagaacaaagctctcctgatggtgttgcctttgttaccttgtctccaactctggggacgcttaaatgctgaagccaggcctgtcatgcaattcacccagcatcagcagggacaattcaggaagaggtggcaccaggaggaaaacagctctggaagggcaggtctcgataatcaaaacccaccttaaaaatggcatcatgatgaactgttcagacaaggcagctctggcttcagtgtgttaatattaaatattttatacacacacacaacacacaacacacacacacacacacacacacacacacacacacacacacacatataaatttgagacggagtctcgctctgttgcccaggctggagtgcaatggcgcaatctcggctcactgcaacctccgcctcctgggttcaagcaattctcctgcctcagcctcccaagtagctgggattacaggctccccccaccacgcccagctaatttttgtatgtttagtagagatgaggtttcaccatgttggccaggctggtctctaactcctgacctcatgtgatccatctgccttggcctcccaaagtgctgagattacaggtgtgagccactgcacccggcctataatcaattatattataagttattttataaattagtgtaataatacatgtgatataaatacaagaatctcccttttatccattttttaaagattttaggtttaagcatacaagtacttacatttgactactagaaagagaataaaaaatagattgtaactatctgctgaaggatgacaaaacagccactggctggtcagtacactcagtcaccagagaagtcttcaaagtagtcccaagaggccagttaggaagggggaaaggaggcagggtaggttcttgagggtgggggaagcaggggaggggcagctcaccagcactcactgtacagctggtttacctgttggacaggacggtgtttttccagcaatctcacttgggaaagaaggaggagcaggtggcccagcttcaccctatgacaagtgtgactttcttgcagccacaccatacccaggctgctcccaccccctcctttcccctctctggctacagctctgactaacccgggtaacctgtccctgggcagctggaatgtgccctcttctatagctgaatgttggtgtctcttttcctggaaaaccataacacttccaacaaaataaggaggccaccgagggatggtggcagctgcagttccccccatgtagaggattccctgcggcaatccagacccagcatgcctggatcttccaattctgcaaaagaattcaaagtccattctgtactgtgaactctcccaagttttaagtgttatcaaataaacatttttaaacaccgcatgagctaaagaaaacatacctgggagcggaaggccacctgtggtcttggttttaggacctctgaacaaaaagatagacttcagtgctcagggtgaacagaaaaatatgtttttgaaagaaataataacttgtcagaaagacgtctactctatgtcacgtcaataccaggcacagcagcgagggaccattggacaccggctgtcctcagttcaagaaaccgcctgaggctgctggcaaattgacctcagggccccggccgcagccacggccccatctcccgggctgaatgctgctgctctagcactcattcatgacaacgaggacatctcaaagctaggaggcccccggaggctccagttcaacaacatacccaaggtcaccccgtgggccacggcagtccggactcccacatcaagctgggcctcctggaagacagcactgaacctagccatggattctgcagacaaccttcaaacccccatctacagccttcaatagcaaaccctgaagcacagtgcgtgctgccctaccctatgacctagttacagacgggcttgcgacggttactaggagtgagagcagaggccctcattgtataaagaccagtgcccatcctgctacctcactgaaatggagggagaaagcctaaatcaccaagtttagagttggtgggcgagaagagaggctacctacggttcagggaaaccagcaaagataagccatccaggctggggcgggggccatccccaccctaccccaagtctcagaaaggctgcgcccggcgtcagggcacccctcctgggtaggggccctgagatgacagttcacacagatcagcccttcagaaaacactgtcatgcttctcaaacacattaaaacacaaatgactacggttcaggttcatggtcaagtccagtccttccatctctccctgacaatctatatgtcctggtcactgcgtggggacttaggtacctccttggccacacagttcaaggtcatttctgttgttgtttttttttcctttggagacagggtctcactccgtcacccaggctggagtgcagtggtacaatcttggctcatggcaacctccgcctcccgggttcaagtgattctcgtgcctcagcctcccaagtagctgggattatagacatgtaccaccactcccagctaatttttgtatcgttagaacagacagggtttcaccatgttggccaggctggtctcgaactcctgacctcaagtgatttactcgcgcctcagcctcccgaagtgctgggattacaggcgtgagccaccgcacccggccaaggtcatttcttcgggggatcttttgtgtagatgtcgtatcttgctcattacatattgatttttcctagttttattcatagaaagaaaccccattttcccaatgtggaagcacctccttatataaggcaaatgtatgaacatttttatcctgcagaaacctgtgtgccctacattgtatgatccagaatagattctggccctccaccataaaaagcacatgttcacaccaaagcaagcaaagacatgcggcactgagcgagagtgtgtgggagggggtgacaagaatggtctgtgggaccccggacagcctttctgggcccccagtcctcactgcacagatgccaataatcactgctgcttccaaggggtgagctggagacagaacgctgagagagtacaggctcacagcaggctgcatctgcgcacgctcttggtgtcatcactactgctggcctgagcaggaaggcccaccctgccacagcggtccctgcacagggctgagtcctgtgaccacagccccattaaaaaatgctctgtgctccatccggctcccttagcaacctcacagggtcccaacctcagagcaggatctggaaggaccgttcactcaccgcaccttggaatgcattcaacttggcggtggcccgaagctgactcccaccagggcagaggaaaaaacacaacccagtgggcaagaggggctgagggaggaggagtagggggcgagggggcagtgctgggcaaaaggaaggggacaccaagggcagacacatccctggatgtccaaatggaaagaaatgaggaggaggaggaagggtcccttgaagggccgtaccatcccgcagaggggacatgaggctgtcccagagaggggtatgggtcctgagaagctagttagcacctctgatgccagccctaatgtccactctccctggtccatggcacaccctctccaggcaggccttcccgagaggagagacctccagagaagcaggatctacggaagggcgagctgacccatggtgacaggtctcctacttccctgcccaagtggttggcatctgtatcttgttcatagtaagatctgctcatgagacaagagccactaagaaatattcacagacaagatgattgcatttggggaaaatgtgacagacctgaagtgaaaacaaaggccaacttacaaaatgtcaagagtccaacaacctgaaatgcaaagcaataatacacacatatacattttagacagcaaattatactcttcaaaaggaaactttagctctaaatttttataactaaaatctgcaattcttttctatccccccaaataacaatgttttaacaggaaactggctatttacataacgtgttcaatagcgtggaaaagcattttgtgtattttattatatgtttattgtttcagaagccaccataaagttgaccacctgccactgccaccccataaaagggaaaacgtctatgtgtagttctattggactcactgggaagccattagctgacccttcattatttttaggcttctgagctaaagtgggaggagaaaatgacgttagaatgcccgttcaccaaacagctactcagtggctgctgctgcagacaccaaggaggtcagcatggggcccacaaagagaaaggacacatccctcttcgtggtccagccaccaaggttttaccaccaccaggcagggccagacctggacatgcgtccccaataccccacctctgcccctgaccacccttgtccttcctggacacttctggacctgaggacagacatttccctcgactgcaaagatgaggcagaaatgacacctggaagcaggggacgagtgagtctctcacacttccctagagtagaagccacagaggtaccaaagtgagggcggagaaacaccaagtgccagcaaggagcggccaaacctctcacatgctgctggcgggagcagacagcgatgccaccaccctggaaaaccgattgccagccacgacaacagttgaacacaggcacactccgtgccccagcaattccactctcctaggcatacacccatccaaacaggcgcgtatgctcaccaaggccacgtacgagaatgtgtcggcagcactgactctaagacccgaaactggaaactaccctagtgccatcaacagcacactggtaggtaagtgcactcatacaagagagcactctacagcaataaacatgaatgaaccactcaacaatacagatggctcttcacaaacacactgttgaaagtgtaagagatcagacactaaataatacatgttgtatgaatccatttatataaagttcaaaagcaagaaaaattaatacaggatgctaaaaatcagaagaaaggttcacctttgggggcagtaagtagaagggagcacaagggggaccttgaggtgcaactgatgttctgcctttgggtgccggctacacagagacattcagtttgtaaaaaacatactgagctatacactcaactgtttgtgcagttctctgcatgtatgttagacttcaacaaaaagtgcaaaaaaaaataagggctgaggagagaaactgttgctaggagacaaagaaatgaagattctggctttggttattagcccttagagcttggagaactgtggatacacgctgaaagcccattaaatttttcaaggaatcttaggaccagagaaacaccaaacctggccatcagtggtctctggtactctgctaccaatctccagacctgtgcctgcaagacatggctgagaaaaagctgcaggcctggagaggggaccctgtccatctcagacatggccggggaaaatggtccagggagatctctatacagaccatgcccaccccatacacaggggagactcaaggctgtacccacttggggagggggtgggtgtacttcacgtgggcatgagcgttcccgaggtgcacgtgggtaagaatggactggatggccctcactggtcaatcactgtcctgcaaatcacgttctgcttccctctgtgaatcactgtccagcagaagcacaacacaagccttgggtgtactttacaatttcctcatagccacattaaaaagaatagaaagaaattaaatttaactatatatatatatatatatatatatatttttttttttttttttttttctgagacggagtcttgctctgtcacccaggctggagtgcagtggcgtgatctcagctcactgcaagctccgcctcccgggttcacgccattctcctgcctcagcctcccgagtagctgggactacaggcgcccgtcaccacgcccggctaatttttattgtattttttagtagaaacagagtttcaccatgttagccagaatggtctcgatctcctgacctcgtgatccgcctgccttggcctcccaaagtgctgggattataggtgtgagccaccgcgtccagcctaacaatatattttcttcaacccaatacattaaaaatattatcctttcaatgtgtaaacaacataaaaaatattcagatgttgtacattctttcatgcacctcaagtctttaaagtgcgtgtgtgatgtagtttggatatttgtccccgcccagatttcatgttgagatataatccctgatgctggaggtggggcctggtgggaggagtttggatcatgggggcagatccctcatggcttgatgccgtctttgtcatattgagttcttgcacgatctggtcatttaaaagtgtatggggcaggtgcagtggctcacacctgtaatcccagcactttgggaggccgaggcaggaggatcacttgaggtcaggagttcaagaccagcctggcaaacatggcaaaaccctgtctctactaaaaatacaaaaattagctgggcgtggtggtgggcgcctataatcccagctactcaggaggctgaggcaggagaatctcttgaaccggggaggcggaggttgcagtgagctgagatcttttgagactctgtctcaaaaaaaattgaaaataataataaaagtgtgtggcaggccaggcgtggtggctcacacctgtaatcccagcactttgggaggccgaggcaggtggatcacgaggtcaggagatcgagaccatcctggctaacatggtgaaaccccgtctctactaaaaaatacaaaaaaaaaaaaaaaaaattagccgggcgtggtggcgggcgcctgtagtcccagctacttgggaggctgaggcaggagaatggcgtgaacccgggaggtggagcttgcagtgagccaagatcacaccactgcactccagcctgggtgacagagcgaggctctgtctcaaaaaaaaaaaaaaaaaaaaagtgtgtggcacctctccgacccccgctcctgctctccccatggtatgcggttgctcctgctttgccttcctctgtgaataaaactccctgaggcctccccagaagcagatgccgctatgcttcctgcacagcctgcagaaccaagagtgaattaaacttcttttcttataaattacccagggtcaggtatttctttatagcgacacaagaagggcctaatacagtgggtgttttccacatacagcagcacatcgcaatcagcaccagccacacatcagtgctccggaaccagctggacagcacaactatgggaaggagtacctgctccccactactccacccctaagggctactgtgaatagctttggctgcaattctctctctccctccctctctttctctctccctccctctctctctgtctgtctcacacacacatacacacacacacatacatacacacacacacacacacacacacatgctgggacctagaataagctgttctatccctctagccacagaggtcaagtcaatgagagatctgccaggaatcttgcagaagaaacagacacttttcccattgggctgaaggtgagagaaaggatgtgaggtctggaattgtagcagctgcttgaggccatgaggtagaggctgtctaggaatggagccacagagagaggagaacagagcccaggaagaaaggaaaagcaatgtggttctgtggacatggctggaacctctgcatcaacagatatatcccctactcttggatttttcagtctcatgtgctaaaaaatttgcttgttcactacgcaaatttgggctgcactgatgtgatctgttattaaaatagtcccagataatacacctcattattctaattatctctgctttttttcccttctagcaactttaaagtttcatattgttgttgaattcttcttactgattcaagttactagtatgcttttaataacatgtctgaatatatctaagcctcaaaacactgcatttcttttgaagctacaatttcagttttaagggctcatcctacgaaaataaccagacaagtgtccaaaaatgtgtacacaagaccattcactatagcaaaaaaaaaaaaaaaaaaaaaaaaaaaacccacaaatgcacactgagaaataagtgggtgtccagtcctaaggagatagcttccctctggcacagagggccccccagtgggcagcgttctttgttccctgcgtggacagcaccctggtagggcagggaggccacaggctcactggagcacggtcacagaaggacgtgatgcaaagaaaaagagccggatgtggtggaaggaagggaacatgcagagagttaggcagggcatggggaggcagcatggggcccactctcccatgtcccagcagagaggaggaacgtctaggagggggagcgggggcagagcctgccaacctggactgctgtcagagcaaacctgtgccagagcaaacctggtggacactggtttagaggcattgaacatcccatttcccgggcaactctgactttccgaaggtgtgagtgggacccagaaaacctcacggctgcagttggggggtgagagtctgggaggtaacagctgggcaatgtggaggcgagacaaggggaccaccatgggaaggaggtgaggtggcccccaagggccagatgggggaatgtgtcaaacactcagaaatcctgcagaggaacccaggggaactgagtcagcgagggaaagtccctagaccataccccagcatgggagaacagatgacagcagtaagcaggtggagaaggagtgctgccttgggggtccatggcaccaaaggatgctgtgcccagagtctctgctcctcacccccagtgacatcagacagctacaccatccctgcttccagatgccattctgaagacgagcctgcagggcaggcagaggctgagaaatctgagaggctcagcactacctatacgggcacttctcaattagaagtgtgcataggaatcccatgggaatgccgttaaaatgcagatcctgctacaaaatatctgggggtggggcctgagaccctgcatttctaacagactcccaggagatgcagagactcctaatggatgggccacactcagagtagtaaggccctcagggacctctgtgaatgaaacagaattaaaacaaccctcccgctctcaagtagatgtaagattcatgcagaagacagactgattatacaaaaaaatagtattaataaggaagacagacgtaccctccacatctgagattagtgtgaatactgtactctgcaactccactacacctacttataatctaataaaaattctgaaggaaacatttataaggcataaagattaaaaatattaaattatatgcttaacatagcctggctaagtgcactctgggggttgaaggcaaggataaggccataaggaaaagagcagtgccttgatcttcctctataaatcaagtcacttagtcctagacaccatttgccttgttaggactgcaatggttctctgacttcacgaataagcggatcctgccttctacccccacatactgccaaacatgacgtttttaaggtttatttaattcatacatgttattatttagggcagattttggttcacagcaaaatggagcaaaaaagggcagaaagttgccatatactccccctctccccagaagcacagctttccccatcagagtggtgtatttctttttcttttctttctttctttttttctgagatggagttttgctcttgttgcccaggctggagtacagtggaacagtctcagctcactgcaatctacacattccaggttcaagcaattctcctgcctcagcctcccaagtagctgggattacaggtgcctgcaaccacaggcagctaatttttttttttttttttgtatttttagtagagatgggatttcaccatgttggccaggctggtctcgaactcctgacctcaggtgatctgcctgcttcagcctcccaaagtgctgagattacaggcgtgagccaccatacctggccagtacatttcttacaatcaatgaacctacacactgacacatcattatcacccaagtccatggtatacattagggttcactcttggtgttgtacattctgtgggtttggacaaatgtataacaacgtgtatccaccattgtagtatcttaagagacagtttcactgctctctgtgccccacctattcatctctccctcccccaaacctctggcaaccactgttctttttactgtctccacagtcttgctttatctggaatgtcatatcttgggaatcacagcagtgtgtagcctcttcagactggcttctttcccttagtaatattaatttaaagttccagatcttttcatagcttgatagctcatttctttttagtgcttagaagtattccactgtttggatatctcacagtttatttatcaatttacctacagaaggacatttccactgcttccaagttttggcaattatgaataatgatgctataaatatccaagtgcaggcttttgtagggccataagtttttaattcatttaggtaaataccaaggagtatgactgtaggctcatagggtaagagtatgtttcattttgtaagaagctgctcaactgccttccaaagtggctgtagtgtttagtgttcccaccaacaatgaatgagactccctgttgctccacctccacatcagcatttgatgctatcagtgttttggcttttagccattctaacaggtgtgcagtggtatctcactgttgttttaatttgcattttcctaatgatatatgatgttgaacatcttcatatgcttatttgacaactgtatatcttcagtgagatgtctgttcaggttgtttgcccattttttaatcaggttatttgttttcttattatcaaggtttaagagttatttgtatattttgaataaaagtccttgatcacatataacttctgcaaatattttctcctaggtttgtcttttcattctcttgacactgtctttagcaagacagaagtttctaattttaaggaagtccagcttaccaattttttctttcatgtattgtccctctggtgttgtatctaaaaaatccatcaccaaacctagggtcattaagatttccttctgtgtaatttatgaagagctgtataattttatgttttacacttaggtctatgatctattttaaagtgcatttttgggaagagtttgcgtgttggcctctagctgttccagccccatctgttgaacacactatccttttgcccttgaattgtttttgttccatgtttcagatattagctaactatattgtgtggtctaactagttagaaataaattgtctattatttaatcaagactacactatcctgattaagtaagtgttgaagtcgagtattgttagtcctctaatttggttgatctccttcgctattgtgtcaactattctgaatcttttgcttttccacataaatttcagaatcagtttattcaaatcctcaaaatcacttgctgagatttctgattattacattttttaaataactacaaaatgattgattttattagtttgttggaaactgcctatctggctatagtctacgtttcagctgttataaaatctgcaagtcctcatacaaaaactttcacactatgatgacacctcactgctgacagcctcctctgcagtcctggagctcctgcaggatacacgctgcatgcacaggtagacatgtgcaacccaggagggcagccagggttttcccaggatgtcaaagctcagaaggaaccaaaaattttaaagatttttaaaaatattttaattttttacaatataggttgaaagcaaatagctccttcaagagctagaacaactgaacttcacatctaataacaagaatgttcaattaaaacagaaagctaccctatggcccttccattcataatgcccatccatgagcctcagcatggactacaagtggatttaggggtccctttcaagatcttcaattgttcagagggcactccactgccctagcggaaggaataaatctgtcacaccacccacaacacagctagttctggagggccaggaccatggcccagaagcagtactgcatgaagattaaacttctcttccttttaagtgtcagatcccaaactgtcaacagtgtatacatgcattgtaacaaacacaaacactaccaacagaaaataatcattcacatgccataggtacatgcatgtgtacacacacacacgcacagactctcacacacatacttcatatttgcttgtcttttactgagaaaaaagggattataatatgcaaaaaacagattttttaaagtaatcatgataacagaaacactcagctaagatgctattctattcatttataaacaccttgcttcctaagggcctgccacaccttaacccatagaactcacttgtggaataaattctttactgaatgaaataagaacttaagtcacaaagtatctattgactatgatatggaaaaaagccttttaaaagcacgtattatcatatataaatacagaatatgaactaagggctacagcaggaaaacgttaactggttatgaattagaatttttatttgtctattgcttgcagggttttattgggcacctagcctgtttgaagcatgaaagctttaaccccaagactcaccctgcaagccaaaagcatactttgttggcaacattaaagcatttctggcttctggcctgggacatcagcaaaaaggcagagtaggcagctccaagggtccatcctccacaaaaccattgaaaattcaagcaaaaactgtcagaatcaactttgtcagaataatggaaacagtaaatggttcgcagcaaccaagcaaaaatggaatggagagaaaggtaaaataaaagcaggaggaaggccctgtggtgttttcatctacccaaatccaccctcctctccagctccacagtgcaggacctggcccctgtcttgaagacagcagcagcattcccagtgcaggacctggcccctggttcccgagggtgcagagcagacttgattcacaaagaattgtgtttgctctaacctgtctggaggctgctgaaggactgattcaaggggctcctctctgttctgtgtaactcagaatgcactcagggcagaaaagtggcaggcactcctggaaaacactagaaggcaaatgagcaacctgcagtccctgggacagaagattaccattgaggcacacggtagagtgccaaaaccatgaaaggaaaggctggggacagggtttaagaaattcaggcattcaacacaaggaactcaaacatctcaacagcaaagaacaaataatcccattaaaaagtgggcaaaggatctgaatagacatttttcaaaagaagacatacaaatggccaggagatatatgaaagaatgctcgacatccatcaccaatcatcagggaaatgcaaatcaaaaccacaatgatatataccatcccaacccagttgcaatggctattatcaaaaagacagaacgtaataaatgctggtgaggatggaaagggaactcttatacactgttggtgagaatgtaaattagtatagctgctaaggaaaatcgtatggagatttctcaaaaaagtaaaaacagaactaccatatgatccagcaatcccactgctggctgtttatccaaaggaaaggaaatcagtatgttgaagagatatccatactcccatgttcattacagcactattcacaatatctaagataggaaatcaacctcagtgtccatcaatggataaagaaattgataaaatgataaattgatacattgttaaagaaaatgggagacacacacacacaaacacacaatagagtactattcacactttaaaaagaaggaaatcctgccttttttaataacatggataagcctgaaagacatcacaccaagtgaaataagcaagccagagaatgataaataccatgcggtgtacgtatgatatactatttggccataagatagaatgaaaatggaatactatctggccataaaaaaagaaaaaaaagaatgaaatcctgtccgggcacagtggcgcacgcctgtaatcccagcactttgggaggccgaggtgggcagatcacttgaggtcaggagttgaagaccagcctggccaacatggtgaaaccccatctccactaaagacataaaaattagcctggcgtggtggcgtgcgcctgtaatccagctactcaggaggcagaggcaagagaatcgcttggacctgggaggcagaggttgcagtgagccaagattgtacatctgcgctccagcctgggcggcagagcgagactctgcctcaaaacaaacaaacaaacaaaaagaatgaaatcctgtcatttacggcaacacagatcagcctgaaggatattatgttaagcaaagtaagtcaggcactggaagacaaataccacatgatctcaaccatatgtgatggctgaaaaaaaatgagctcatggatatagaaaattagaattgtgggtgcagagtctgggaagggtaccagtgaggggaggatgatgagaggttggttaatggatacaaagttgcagctagataggaagcatgaattctggtgttctatagcactatagggtgaatatggttaactacaatttattatatattctcaaaaagctagaatagaggattttcaatgttcacaacacaaagaaatgaggtgatggatatgctaattatcctgattcgatcattacacattgtatacacatattgaaatatcactctgtatcccataaatatgtacagttattatttgacaactaaaaataaaagggaaaaagaaattcaagcattccaaagcacctatgcatatgggtgggaatgtagacagccatgtgaatgcccagagcagaacgcatgctcagaagaagcctgagaagaccccagtctttcacctctggatgagctccaggttcagtataaacaagaaatgaaggtcaaggcatagctgtaaaaagccaggctaagtgttaaaggaggactccaccacagagccactccatacagataagcggtcagtctcttctctctctgtttttctctgcctctctctccaaccccctcgctctctctatcatgttttggcatctggtgctcaaggaaatctctttgacagcactagctgaacaaacaactaaacagagacttcagagaccacacacggtaaggaattacagatcttgcaaaactctacagtctatagcaagcaacaacaaaccctgaggtgggggaagaatctgatctccagagttacctctgtttaatatgcaaaatgtccaggcgtttgttcgtttgttttgagacagggtctcactctgtcacccagggtggagtgcagtggctcgatctcagctcactgcaacctccacctcctggattcaactaattatcctgcctcagcctccagagcagctgggattacaggcatgcaccaccacacctggctaatttttctatttttagtagagacgggattttgccatgttggccaggctggtctcaaactcctgacctcaagtgatctgcccaccttaacctcctaaactgctacaattacaagtgtgagccaccatgcctggcatgttcagttttcaacaataacttatgaaccatgtaaagaaacaagaaaatatggctcattcacataagaaattaacaaacattgtccctgaagaaacacacacactggacttactaaagactttaaatcaactgccctaaatatgctaaatgacttaaaggaaagaaaggaaaaggagctaaaggaaatcaggataagaatgtatgaacaaataagtgaattgaaataaagatatagaaattataaaagggagtcaaattctaaggtcaaaaagtacaccaactgaatttttttaaaaatcactagagcatctcagtaacagacttgactaggcagaagaaagaacccgcgaacataaagacagggcaatgaaaattatccagtctgagaggaagaacaaaaatgataaaagattaacaggtatgaaatgccatcaagcataccaataccaagtacataacaggaatcccagaaggagaggtgcgagtgaaaggaacacaaagaatatttggagaaataattgccaaaacttaccatacctgataaaagatacaaatctacacacacaagaagttcagtgagtttcaagtgagatgaatacaaagaaatccacactgagacacattataatcaaacagtcaaaaagccaagggcaaagagaaaaatcttgaaatcagcgagagaggagccactgattcacatacaagggatcctcaatcagattaacagctgacttctcatcagagaccaggggaccagaaggcaatgaaatgacattttaaagtgatgggcaggatgggggtgatgcttccaaccaagcattgtatgatacatcctacaaaaatacccttgaaaaatgaaggagaaatttacacccacatattgaatggctccaattgtataaaatatcagaaacaggtaacaatccacagggacataattcagactgatggcttccaggggctaggagaggggaaatagggagaaacaatttaatgagtatgggatttcctctggagacaatgaaaataattttggacttttatagagggagtggttacacaacggtgtgaatgtactaaacgtcaaagaattattcacacaaaaattattactgttaagttaatttcacctcagtaaagaaaaataaaacatgggaaaaactggcttctgacaaactgatcaaagttctgaatcacaggcagtagcagaagcagcatggattaccctgagatctcttccttccttccttacctgcctggccgagagaaatatggagcgagggtactgatttaagataatatgctaactgggtgcttgtagcaatatcaaaaggtaatgtaatatagactaaaccatatggaaccatgaactgccaaggacatgagttacctgccaaagtaagacgttgcccttgggtgcagacagaaaacatggtggggtgatctttatcaacagtcagcaacaggataaaattccatgtgtaaaggccacctgaactttgattctgtatgtgcgtattttacaagaatgtaagagcagtccaaaaactattttaattgaattcattctatacataggtgcatcccaatgccaattactggcatcaattctaaaccaataaataagaacatatgtattttacgcacaaaatgtcatgtctctctggatatcccatgcacaaccccaacagtacccgtccatcagagcctgcagctctatgaaggagaacttaacagcactctaggtgaacacgcccctgcctgatgccgtccacaaagctaggcacatttgcacgtctgggtaccatcgctcagctacacaaccacaggccatgacggcgcagttcttccaactaggctgtgctgacacaggtctcgagatggctgatgcttttgatgcatcctgaagttttgctacaaagatcaccacaaaaatgttcaagcatcaaaatgttttaattcttctgaaatgaaactgtctctaaatagctcagcaataaaattcaataattctattgggttcaaagcagtttaacaatggaaaatgaattatatagtcaaaggtggtccattctcgctctccagtaaacatttctgtatgtgcggaattggtgggttctcggtctcactgacttcaagaatgaagccgtggacccccggtgaattttacacttcttaaaggccggtgcatctggagtcgttagttccttgtggtgttcggacatgttgggagtttcttccttctctcccaatgggtttatggtctctctggcctcagaagcaaagctgcagaacttcgctgtgagtattacagctcttgaaggtaatacagagcctaagagtgagcagtggcaagatttaccgcaaagagcgaaagaacaaaacctccacaacatggaagagaacccaaacagtttgcggctgctggctccggcagcctgcttttattcccttgtctgaccccacccacattctgctgattggcccattttacagagagctgactggtccattttacagagagctgattggtccgttttacagagagctaattggtctgttttgacagggtgctgattggtgcgtttacaatcgctgacctagacacagagtgctgattggtgtatttacaatcctctagctaggtgtaaaagttctccaagtccccactagattagctagacacagagcactgattggtgcatttacaaaccttgagctagacacagagtgctgactggtgcatatacaatcctccagctagacataaaagttctccaagtccccacctgactcaggagcccagctggcttccgctagtggatcccgtgccagggccgaaggggagctgcctgccagtcccactccaggcgcctgctctcctcagcccttgggggtctatgggactggacgcctatggagcagggggtgatgcccctctgggaggctcaggcaggaggctcgggcagcacgggagcccactgcagggggcagcatggcgggctgcagatccccagccctgacccgtggggaggcggctgaggccccgcgagaattcgagtgtggcacaggcgggccagcagtgctaggagacccagcgccccctccacagctggtggcccaggtactaagcccctcactgcccagggccagtggcaccagttggccactccgagtgtggggccgctgcctgcacccacccagatcttgggctagcccacgagccctgtgcacagccctggttcctgcccgcacccctccctccacacctccccgtaagcagagggagctggctcctgcctcggccagcccagagtggggctcctacagtgcagcagggggctgaagggctcctcaagcgtggccaaagcagacatcgaggcccaggaggtgcagagagtgagcgagcgagcactgctagcacattgtcacctctcatctagacttgttgagtgtgagtacctgccctttctggaacaaaccatcaattcttttgctccctacaattttaagttccaatctggtgagccctagggtccctaggtttcatattgtagaaggctttaaatctaaagagtccttggataaatggaagggcaaagtaaatctcaggaagtttcacacagtagctatctgactgcattcaagaaagaaatctctgtattttccttcaacttctctcacacagcccaaagttgttgggagaaggtaaaggaaaaaacatgaagatttatttcatggagatagccagcataggggaaattatttaccttttcgacttagaacaactagaaaacaagtttccaatcatggtcatctcctgcctcacagtagacattaaagttaagttagagaattcacaaccacacccttctgattgacactatacatatcaatctcgttactcaactgaggggaaaaaactatttccatcagctagaccttttcctgcactccatgaaaagctcaaacactcaggatgtcaaacttaacttttttgcaatcacacagcaaggcccaatctgtcaaagccatacgattcactgcctttatttctactgttggtttgatttttttttttttctagcttgtgggtttcagggcagacaaaggcagctaaaagtctcagggagaaaaagaatctccagtaggctgtaccatagacatccccatttattgcatgtaacttacttcacttctcaaccccacagtttaatcacctgtataaaactggcgcagtaatactcagactgcaaagtcattgtaagaattagcagtagcatgaggaaaacatcagctcatgttaggaatgcactgattattacctggcattatttagattgattaataagttcatatatgcatagtgggaaacaccttggtctaacattctttggttctaattatgattacgatatcatgtgatttccatgtgttagagagcaagtcataattatcaccattgtaaaaggagaagtacattctacatcagattgacaaattgtgttctataaaactctaagaagccaggcagatacctcaagagccatgaggactcaataggaaggttgctaaattctatgagctatcggttatgaccttcaagtgttaaacatattaatatagaggtataacttttcccgataggaaataaaaggcaattactattttaacatgctgccaaacacactgcctattgttaaaataattgttaaaatttttattgaggctgggcacggtggctcatgcctgtaatcccagcactttgggaggccaaagcaggtagatcacctgaggtcaggagttcgagaccagcctggccaacatggtgaaaccccgtctctactaaaaatacaaaaattagccaggcgtggtggcgggcacctgtaatcccagctattcaggaggttgaggcaggagaatcgcttgaaccctggaagcggaggttgcagtgagctgagatcacgccactgcactccagctggggcgacagagtgagactccgtctccaaaaaaaaaaagtttttgttgaaataaattattttaaataacagtgacttcagttaaaatcctaattagtgaacttattagtaattcaataatagtatttccaatgcttccctgacaacccttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgacaactctttttacctcataaagagaagctatgtaaatcctgaggcaaacagcacgcttaatgctgagcatttaaaagcattctcaggcagaaggatcacttgagcccagtaattcaaggctgcagtgagctatgataacaccactgcactccagccagtgtgcagagtaagatcctgtctctaaaaataaataaatagttcagatagaaataaacagaatatagatagatagacagatagagataataaaagcattcctggctaggcatggtggctcaggcctgtaatcccagcactttcggaggctgaggtgggcgaatcacctgaggtcaggagttccaagaccagcctggccaatatggtgaaacctcatctctactaaaaatacaaaaaattagccagggtggtggctcacacccgtaatcccaggtactcgggaggctgaggcaggagagttgcttgaacccaggaggcagaggttgcagagagccaagatcacaccactgtactccagcctggccaatagagtgagactccatctcaaaaaatttaaagaaagcattcccaatgaagacacagcaaaaatgctctccttcactattactattcaatatttaatgggaattcccagccagcacaattaagaaaataagtaacaaggatcgaaaagagacaatattatcattctttactgacagaatgattacatataaaattcaaaaacatatacaaagtatcagacctaatacgagtttggaaagactataggaaaaaaaaaaactttaaaaacgctttccaatatttcaataacaatcaattaaaaaccatttttagaattagcaataaactccaccaggtacctagaaaaaaactaagacacaagaactttatacacataaaattgtgccaaaatacgttaaaatgtattcaactcttccagctttattgtggtataagtgacaaataaaaattgtatatattttaggtgaacaacataagttgatacacatattcactgtaaaatgattaccacaatcaggccaattaacatatccatcacctcacatagttaccatttttatccttgtggtaagaatatttaaaatctactctcttagcaaatttcaagtatacaaaacattattattttagttatagccacattaggtctccaaaactaactcatcgtgtaactgaaagtttgttcgctttgaccaacacctacccatttcccacaggcccagcccctgcaaccatcattctcctctctgtttctatgagccacgtttttagattccacatataagtgagaccatgtggtatttatcattccctggcttgcttatttcacttagtgtaatgtcctccaggcttatccatgttgttcaaaaaggcaggatttcctttctttgaaggctggctaatactcctctgcctgtgtgtttgtgtgcatgtgtgtgtgtgtctggatgtgtgtttgtatgtgtgtcacattttatcagtttatccactgatggacattaggttgttcccattatcttggctattgtgactaatgctgcagtgtacatgggggtgtagatttatctttaaaacactgatttcaattactttggatatatacccagaagtagaattgttggatcatatggttgttctataattttttgaggaacctctatactgtttaccacaatggcagtaccaatttacattcccagcatcaatatataagggttcccttttctccacaacctcaccaactcttgttatctgttggtactttgagaatagccattctaacaggtgggagatcacatctcattgtagttttgatttgtatttccctgatgattgatgatgttgagcactttttcacatacttgttgccatttgtatgtcttctgtgagttgcctttacatttcattgtttcctttgctctaaagaaatattttagtatggtgtagtccaattatttgtttttacttttgttgcttctgtttttggtgtaatattcaaaacatcactgctaagatccatcttattgagctttctatgttttcttctaggagttttgtggcttcaggcctttcctttaaatctttaaacaattttaacttgatttttgtgtacagtgtcagataactctccaattttgtttcctttcatattttttctttttttgcatgaggatatccagttttcctaacaccattaattgaaaacaatgatccttttcccattgtgtattcatggcacctttgtcaaagattagttgaccatatatgcatgggtttatttatgggctttctattctgttccattggtctatgtgtctgtttttatgccagtagcatgtttttttggctactatagctttgtaatataatttaaaatcaggagatgtgatgacttcagttttgttcttcctgttaaaaattgcttgggctattcggggtcttttgtggttccctatgaattttaggattgttttttctatttctgtgaaaaatgccaatgaaattttgatagactgcattgaatctgtagatcactttgggtattatgaatatttttataatattgattattctgatccatgaacatgggatatcttcccatttgtgtatcattccatttcttttatcaatgtttcatagtttttggtgtatagatcttgcatctccttatttaagcttatttatgttattatttttgatgctattgtaaatcagactgatttcttaatttctttttctaatactgtacactaatgtgttattagtgtacagaaacacaactgctttttatatcctgcaactttactaaattcatttatagttctaattagttttggggtggtgtctttaggaatttctattacaagatcacatctcctgcaatcagaaacaatttcctccttcccaatttggatgactaataaaataaataaataaaataaaataaaataataaaattatttttactgcctaattgctttgactaggatttccactactactttaaataaaagtggtgagagtgggcatccttgtcttcttcctgattttagagaaaaagctctcaaccatttatggttgactatgatggtagcttgtgaaatatgacctttattgtgttgaggcatattatttctatacctaaatttgtttagagtttttgtcataaaagattgttgaattttgtcaaatgttggtttaaatatttgagataatcatataatttttgtccttcattctttctgttaatgtgttgtaccacacttattgattatattgaactatctttgtatcccagggataaatcccacttatttgtttaatatgctattgaattcagttttctagtattgtgctaaagatttctacacatatattcatcagggatattggcttgtaattttctttccttgtagaatttttgcctggctttgctatcagggtaatgctagcctcataaaacaagttggaagatgttccttcttgctatggtttgaatatgccctccaaagttaatgtgttagaaacttaatccccaatgcaacagtattaggaagtagggcctaatgggaggtgcttaggtcatgagggttccatccttatcaatgcattaatgctgattataaaagggcttgaagctgtgagttccatctcttgctctctcgcactctttttctcttctgccttctgctatgcaatgacatagcaagaggatcctcaccagatgtgggccctagatcttggacttccccgtctccaaaactgtaagaaattaatttattttctatgtaagttaccaagtctgtggtattttgttacagcaacacaaaatagactaagacattttctcttcaattttttttggaagcgtttgagaagcactggtattaattcttctttaaatgcttggtagaattcatcagtgaagccatcggatcctggacttttctttgatagaaagatttttgttactgattcaaacttcttactcattattagcctgttaagacttctttttcttcacgattaaatccaagacttctttttcttcatgattaagtctttgtaggttgtgtgtttctaggaatttatccattacttctgggctaatttattggcatataagtgtttgtagtactctcttaggatcctttgtaatcctgtggtatcaattgtaatgtcttccctttcatttctgattttattttagtcttcttttttcttaatctaattaacagtatgtcaatttcatttatcttttcaaaaaaccaactcttagttttgctgatcttttctattatttttctaagttctatttcatgtatttgttctctgatctttactatatccttccttctgctaactttagtttgttcttctttttctagtttctcaatatgtaatgataggttgtttatttgagatctttcatttttcttcatgtaggcatttttcactataaactttcctcttaaaactacttttgctgcatcacctatgataagatttggctctgtgtccccatgcaaatcttatctcaaattgtaatccccatgtgttgagggagggaactggtgggaagtgactggatcacagaggtggtttgccccatgcttttctcgtgttagtgactgagttctcatgacagctgatggcttttaagtgtggcacttcctcactctctcctgctgccttatgaagatgtgccttgtttccccttcaccttctgctatgatcgttaagtttcttgaggcctccccagccatgtggaactgtgagtcaattaaacctcttttctttataaattatccagtctcagtatctttataacagtgtgagaatggactgatatacccaaagttttggtacactgtgttttcattttcatttgtctcaagatattttttaattttcctactgatttcttctgctccattggttgggagtatgttgtttgatttccacatatttgtaattttcccaattcccttccattagttatttctagtttcatgatactatgatcagaaagaaatattacataatttgatatataattaaaatataatttcaatctgcttaaatacattaagacttgttttgtggcccaacgtataacctatcctgaagaatgttccatgtatactttagaagaatctgtactctgctgctgttgaatagaatgttctgtatttctgtatatatctgttaggtctacttggtataaagtgtaaaatctaatgtttccttactgattttctctctggatatcctgtctgtagttgaaagttaggtaatgaggtccctcattattactgtattgctgtctatttctcctttcagatctattaatatttgctgtatattatttacgtggtctgatgttgggtacatatatgattattgtgtcctcttaatgaattgatccctttttcattacataatgacctttttgatctcttttaaagttttgtagtcaaactatattttgtctgatataaatatagctacccctgctctcttttggtttccatttgcaagaagtatcttaattccttcacattcggtttatgtatgtctttaaagttgaagtgattttcttacggcagcatatagttgagtcttgtttttaaatctattcagccaatctgtcttttgactggataatttaatgcatttacattcaaggtaattattgataagaactttcaattgtcattttgttaatttgtttctgggtgttttgaggatgccttgatcctttcttcctctcttgctgtcttcctttgtgacttgacaattttctgtagcagtatgctttgattcctttctcttcatcttttctgtatctactatatgtttttgctttgccattaccatgaggcttacataaagcatattatagttataacagtttaagctgataaaaacttgtttgtttgttttgagacagaggcttgctctgttgcccaggctggagtgcagtggcgtgatcataactcactgcagcttctaactccttgagagatgatcctctcacccaagcctcctgggtacctaggactacaggtgcacacactaggctaattttttttttttttttagaaatgaggtctcactatgttgcccaggctgatgtcaaacacctaggctcaagcaatcctcttgctttgtcctctcaaagtgctgagattacaagtgtgagccaccatgcccagtcaaaaacttaactttgataacatacaaaaactctacactactttctgatagtgaagtgtaagtaaattcttcctaattggtaattacatattgtgtaaatgaactaaactctctaagagaaaggcagagattggcagaataaattagaaacttgtggaactgtatgctgtctacaagagactcactttagattaaaagacaaaaacaggttgaaagtaaaaggaaagaaaaggatatttcatgtgaacagaaaccaaaatagagctggagtgtatacactaatatcagatgaaatacactttaagataaaaattgctactaaaaacaaagcagcacaatatacactaataaaaaggtcaagtcattaagaaaatactgcaattataaatataccacacctaccaacagagtcctaaaaatacctgaagcaaaaaattgacagaattgaaatacaaaatagggaattcaacaataatagttggagaattaaatacctcaatttcaataatgaatagaacaaatagaataacagcaaggaaacagaagacttgaacaacactataaaccaatcaacttgacatctatagaacactcaacccaacagcagcagaatacacattcttctcaagcatacatggaacattttcctgatgaaacatatattgggccaaaaaacaagtctctgtaaatctttaaagattcaaataatgcaaaacatgttctctgatcacaaaagaataaattaagaaatcaatcacaaaaggaaaactggaaattcacaaatacatgcaaattaacaacacattccattggccaatgggtcaaagaagaatttacaagagaacttagaaaatactttgagataaaataaaaataaaatacaatatactaaagcttaatctttcatatcagagtttaatccatttgaataaaagcagtgctcagagggaaatttatatctgtaaatgccttcactaataaaataaaaaactctcaaatcaataatctaaccttccaccataagaaacttaaaaaagagcaaattaaatctaaatcaaacacatacaaaaaagagattggagccaaacagagaacagaaaaacaacatagaaaatcaacaaaaccaaagttggttctttgaaaagatcaacaatattgacaaactttagctaggctgagcaaagaaaaaatagaagactccaattactaaaatcaggaatgaaagagagaatatcataattctaagaaaattctatgaaagctggataccatcaaattagataccctagatgaaatggacaaattcttagaaacacacgatctaccaaaattgactcaagaagaaacagacctgtagctaataaagaaatgagtcaacttttctaaaaaaaaatctttcaatgaggaaagcctcgaccagatggtttcattggggtattctacaaaatgtttaaagaaaaattaacaacattatttctcaaactcttacaaagagtagaagagaagggaatacttcgtaattcattctgtggaagtgaaacacatcaaaagtaaaaactacagatcaataaccgttgtgactacagatgcaaacattctcaacaaaacattagcaaatggaatctaacagcatatgaaaggggttattcaccatgaccaagtagagtttatcccagaaatgtgaggttggtccaacatataaaaatttatcaacataataaagcatattagcataaacccacatgatcatctcaatagatgcagaaaaagtatttgacaaattccaacatcttttcatgataaaaattctcaacaaattagaaacagaaaagaaaatttcttaacctgataaagggcatccatgaaaaaccaatagctaacatcatacttaacagggaaagactgaaagctttgctcctaagatcaggaagaagacaaggatgtctacctctcaccacttctattcaacattttactggaggttatagccagggcaaaaaagaatgctgtaggcaagaagatgaaataaaatgcatccatactgaaaaggaagaagtaaaagtatctctgttcacagatgacctaattttatatagagaaaaccctaaataataaacacacatacatattaaagctaataaatttggcaaggtgacacgatataagttcaatgtataaaaatcagttgtatttgtatacacacaatgaaaaattttaaaatgaaatgaaaaagacaattccatcaacaataccagtaaaaagaataaaatattcagaaaaaatctaactaaagaagtgcaagacatatacactgaaaaccataaaacattgctgaagtaaattaaagactgaaataaatgaaaatatatctaatgttaatggacagatcaaagcaattcctatcaaaaatctcatcgagaatttttttttgcaaggatcaacaaactaatcctacaattcatatggaaattcctgaaacccagacaagtcaaaacaatcttgaaaaagaacaaagtgagaggaatcacactttctgatttccaaatttactacaatgctacagtaatcaagacagtgtgatactggtataagacagtcaaatagatcagtgaaacagatctatggccaagtaactttcaacaagagtgccaagaccattcaataaggaaagaataattttctcaagaaatggttctaaaactagatatccacatacaaaggaatgaagttggaccccaccttataccatatacaaaaattaatgcaaaatgaatcaaaggcctaaatgtaagggctataactaaaaatcctagaaaaaaaaagcatagatataaatctgtgcaactttgagttaaggaaaagttttttggaaaggacactgaaagcatgtgtgaccaaagaaaaaatagatgaattgaacctcatcgatatttaaaacttttatgtttcaatcagccctatccacaaaatgaaaagacaacccatagaatgagggaagacatttacaaatcatatgtctgataaaggtctagtaaccagcatatataaaggactcctagcattcaacgacaagaagtcaaataactcaactaggaaaagggctaaggatttgaacaaaaatttctcgtaagaagatatacaaatggccaataaatgcatgaaaagatctttagggaagttcaatatcattggccattagaaaaatacagatcaaaaccacaatgacataccaatttcatacccactaggatggctagaataaagggggaaaaaaaaaccagaaaataagtgttggcaagaatatgaagaaactggaactcatacgttgctgataggaatgtaaaatgttgcagctgctttggaaaacagtctggtagttaaacactgaattaccgtgtgactctgtaattctacccttacatatatacctaacagtattgaaaagatatgttcacacaaaatccagtacactaaatgttcacagcggcaatcataatagtctaaaagtggaaagaaaccaaatgttcatcaattgataaatggttaaacaaaatgtggtatatacatatggaatgtcattttccacaaaaaggaagtgctattgcatgctataacatggatgaaccttgtaaacattatgctaagtaaaagaagccaaatacaaaaggccacatattgtatgattccagttatgtgaaatgtccagaagaggcaaaatcatagaaacagatagtagatttgaggtgccaagggttagaggattggggaattggaggtgactgctaacagttatgagatttctttttggggtgatggaaatgttccggaattacgtcatgatgatttaacataacactgtgactatactaaaaaaacactaacctgtacacttcaaaatggtgacttgcatgttatgtgaataatacctcaataattaaaagaagtaaggataataaaatcatcttaatcagccagctatgctagagcaagtaaagctaaatatctttttaggatctagagaaaataaaattataaaattatcatactaatagacaattaatgaatatgcagcaaaaaactattacaaagatgggtcatgcaattctttaacttgtaaatgttatttttctcaactgtgtggtatatttcatgcatttaaagcatttttaagtttataattcattgtgatttgttttttcattccaaataaatatccactgtcatgactaaatttgtatttacaattttgtattctttctgttaaaagaactgagatgggccctacaaaacttgaatcctccactggagataccttttcacaaccatcacagtagctaaaattaaaaagtctaataatacttggtattggagagaaagtagacgaatgttaactctccttggccctactaggagtacagattgatttaaacaatttgaagagcagtttgacgattatagtgacattaaggtgccccaggaattctacttctagagacaggctctaccaacatgtttctacctatgcacccctgcagcatgttgtaaaggcagaacaccagaaacaggctaaacggtcagcaacaacacaacacagaagattgggatatgttctcagaagggcactctatagaggagttaaatgactttatgcagatcaacccacatggaagtggaaaacaataccaactgtgaaaagcaagtttcagaatgacatcacagttaaaaccatttgtgtgatgttttgaaacatgcacacaagtactacatattgattccagaaacaaagaaatgaagtaaaagagaaattcctctttgtttacagaggaaatagacaggttggaaaaggacacgagagactgtaacttgatctgtgatattttgagacaccatgaagaagaactgaagcgtgtgtttccaagtttaggcatccatgaattctgcctcgtgcttttatacttaggattcttaggctcactctctgaccttttctatttgaagctggattcagactatttacctgagtggaggaaatacttgaatcttaaagatcaaactcaccaacaaagaagtggggaaagcagtcatgagtaattcatgaaatgctaagtaaaataataatgcattcataacatttttcatctatcaaactagaagctctggtgtcttccatgatgatacccagggctggcactgtcatgttaggtcattagaaagccttgaaaacatatttatccctttgcagaagcaggtctgttctcataaggagattcttctgaagttgtgcaaagattttgatacaaggatgtacaatgccaagtcaccttgtagatgacaagagaaaaaggagaaaaaatgtccaacaactgtttgttaaattggaatatcttatacaaaccataaacatagagtggatacttataaagacaataaaaaaggcatggagaatgtttaagtgtttagaaaacatgctccccctgggcagagcccaccccagtgccacaaagccactgtagccagactgcctctctaggttcctcgtctgtgggcaaggcatctcggaaagaaaaacagcagcacccgtcaggggcttatggataaaactcccatctcccttggacagagcacctgggggatgggacagctatgggcgcagcttcagcagacttaaatattcctgcctgctggctctgaagacagcagtggatctctcagcacagtgctcgagctctgctaagggacagattgcctcctctagtgggtccctgaccccagtgcctcctgatggggagacacctcccagcaggggttgacagacacctcacacaggagagctctggctggcatctggcaggtgcccctctgagatgaagcttccagaggaaggagcaggcagcaatctttgctgttcagcagcctccgctggtgatacccaggcaaacagggtctggagtggacctccagcaaactccagaagacctgaagatgaggggcctgatgaccgttagaaggaaaactaacaaacagaaagcaatagcatcgacatcaacaaaaaggatgaccaagcaaaaacaccatccgagggtcaccaacagcaaagaccaaaggtagataaatccatgaagatgcagaaaaaccagagaaaaaaggctgaaaattccaaaaaccagaatgccccttctcctccaaaggatcacaactccttgccaacaagaaaacaaaactggacagagaatgagtttgatgaactgacggaagtaggcttcagaaaatgggtaataacaaactcctcctagctaaggaagcatgttctcatccaatgcaaggacgctaagagccttgaaaaaggttagaggaattgctaaccagaatagccagcttagagaagaacataaatgacctgatggagctgaaaaacacaacacgagaacttcgtgaagcatacacaagtatcagtagcccaatctatcaagcaaaagaaaggataccagagattgaagattaacttaatgaaataaagtgtgaagacaagattagagaaaaaagaatgaaaaggagcaaagcctccaagaaatatgggactatgtgaaaagaccaaacctacgattgattggtgtacctaaaagtgatggggagaatggaaccaagttggaaaacacacttcaggatatcatccaggagaatttcaccaacctagcaagacaagccaacattcaaattcaggaactagagagaacatcacaaagatactcctcgagaagagcaaccccaagacacataatcatcagattcaccaagattgaaatgaaggaaaaaatgttaagggcagccagagagaaaggtcgagttacccacaaagggaagcccatcagactaacagcagatctctctgcagaaaccctacaagccagaagagagtaggggccaatattcaatgttcttaaagaacagaattttcaacccagaatttcatatccagccaaactaagcttcataagtgaagttcaatagaatcctttacagacaagcaaatgctgagggattttgtcaccaccaggcctgccttacaagacctcctgaaggaagcactaaatatggaaaggaaaaaccagtacagccactgcaaaaacaaaccaaaatgtaaagactatcaacactatgaagaaactgcatcaacaatgggcaaaataaccagctaggatcttaatgacaggatcaaattcccacataataatattaaccttaaatgtaaatgggctgaatgcccccaattaaaaggcaaacactggcaaactggataaagagtcaagacccatccatgtgctgtatttaggagacccatctcacatgcaaagacacactaggctcaaaataaagggacggaggaagatttaccaagcaaatggaaagcaaaaaaaaagcaggggttgcaatcctagtctctgataaaacagactttaaaccaacaaaaatcaaaaaagacaaacaagaggattacataatggtaaaagaatcaatgcaacaagaagagctaactatcctaaatatagatgcacacaatacaggagcacccagattcataaagcaagttcttagagacctagaaagaggcttagattcccatgcagtaatagtgggagaatttaacaccccactgttgatattagacagatcaatgagacagaaaattaacaaggatattcaggacttgaactcagctctgcaccaagcagacctaatagacatctacagaactctccaccccaaatcaacagagtatacattcttcccaggactacatagcacttattctaaaattgaccacataattggaagtaaaacactcctcagcaaatgccaaagaacagaaatcataacggtcactcagaccacagtgcaatccaattagaacttaggattaagaaactcactcaaaactgcacaactacatggaaactgaacaacctgctactgaatgaccactgggtaaataacgaaattaaggcagaaataaataaattatttgaaaccaatgagaacaaagacacaacgtaccagaatctctgggacagctaaagtagtgtttagagggaaatttatagcactaaaatgcccacaggagaaagtgggaaagatctaaaatcaacaccctaacatcacaatgaaaagaactagagaagcaagagcaaataaattcaaaagctagcagaagacaagaaataactaagaccaaagcagaactgaaggagatagagacatgaaaaacccttcaaaaaatcagtgaatccaggagcagattttttgaaaagattaataaaataggccgctagccagactaataaagaggaaaagagagaaaactcaaatagacacaataaaaaatgataaaggggagattaccactgaccccacagaaacaaaaactacaatcacagaatactataaacacctctatgcgaataagctagaaaatctagaggaaatggataaattcctggacacatacaccctcccaagactaaaccaggaagaagtcaaatccctgaatagaccaataacaagttctgaaattgaagcagtaattaatagcctaccaaccaaaaaaagcccaggaccagatggatttacagccgaattctaccagaggcacaaagaggagctggtactgttccttctgaaactattccaaacaacagaaaaagagggactcctccctaactcattttatgaggccagcatcatcctgataccaaaacctggcagagacacaacaagaaaagaaaatttcaggccaacatccctgatgaacaccaatgcgaaaatcctcagtaaaatactggcaaaccaaaccagcagcacattaaaaagcttatccaccacaatcaagtcggcttcatccctgggatgcaaggctggttcaatatacacaaatcaataaatgtaatgtatcacaaataaacagaagcaatgacaaaaacgacatgattatctcaatagatgcagaaaaaggtcttcgataaaattcaacaccccttcatgctaaaaactgtcaataaactaggtattgatggaacatatctcaagataataagagctatttatgacaaacccacagccaatatcatactgactgggcaaaagccggaagcattccctttgaaaccagcacaagataaggatgccctctctcaccactcctattcaacagagtactggaagtcctggccagggcaatgaggcaagagaaagaaataaagggtattcaagtaggaaaagaggaagtcaaattatctctctttgcaggtgacatgattgtatatttagaaaacctcatcatctcagcccaaaaactccttaagctgataagtaacttcagcaaagtctcaggatacaaaatcaatatgcaaaaattacatgcattcctatacaccaataatagacaaacagagagccaaatcatgagcaaactcccattcacaattgctacaaagagaataaaatacctaggaatacaacttacaagggatgtgaaggacctcttcaaggagaactacaaaccactgctcaaggaaataagagaggacacaaacaaatagaaaaacattccacattcatggacagggagaatcaatatcatgaaaatggccattttgcccaaagtaatttatagattcaatgctattcccatcaagctaccattgactttcttcacaaaattagaaaaaaattactttaaatttcatatggaaccaaaaaagagcctgtatagccaagactatcccaggcaaaaagaacaaagctggagggcatcacgctacctgacttcaaactatactacaagactacagtaaccaaaacagcatggtactggtaccaaaacagacatacaggccaatggaacagaacagaggcctcagaaatgacaccacacaactacaaccaaatgatctttgacaaacctgacaaaaataagcaatggggaaaggattccatatttagtaaatggtgttgggaaaactggctagcatatgcagaaaactgaaactggaccccttccttacatcttatacaaaaatcaactcaagacggattaaagattttaacgtaagacctaaaaccataaaaaccctagaataaaacctaggcaataccattcagaacacaggcatgagcaaagacttcatgactaaaacaccaaaagcaatggcaacaaaagccaaaattgacaaatggaatctaattaaactaaagagcttctgcacagcaaaagaaactatgatcagagtgaacaggcaacctacaaaatggaggaaaatttttgcaatctattcatctgacaaaggggtaatatccagaatctacaaggaacttaaatttacaacaaaaaacaaacaactccatcaaaaagtgggtgaaggatatgaacagatacttttcaaaagaagacatttatgtagccagcaaacacatgaaaacaaactcattatcactggtcattagagaaatgcaaataagaaccacgatgagatgccatctcatgccagttagaatggcgatcattaaaaagtcaggaaacaaaagatgctggagaggatgtggagcaacaggaacgcttttacaccattggtgggagtataaattagttcctccattgtggaagacagtgtggcgactgctcaaggatctagaactagaaatactatttgaactagcaatcccattactgggtatatacccaaaggattataaatcattctactataaagacacatgcacatgtatgtttattgcagcactattcacaatagcaaagacttggaaccaacccaaatgcccatcaatgttagactggataaaaatgtggcacatatacacctgtaatccagtactttgggaggccgaggcgggcggatcacgaggtcaggagatcgagaccatcctggctaacacgatgaaaccccatctctactaaagataccaaaaaaattagccgggcatggtggctggcacctgtagtcccagctactcaggaggctgaggcaggagaatggcgtgaacccgggaagtggagcttgcagtgagctgagatcatgccgccactacactccagcctcggcgacagagtgagactccatctcaaaaaaaaaaaaaaatgtggcacatatacaccatggaatactatgcagccataaaaaagaatgagttcatgtcctttgcagggacatggatgaagctggaaaccatcgttatcaacaaactaacatgggaagagaaaaccaaacaccacatattctcactcataagtgggaggtgaacaatgagaacatatgggcacagggaggggaatatcacacactggggcctgtcggtgcggtggggggcaaggggagggatagcattaggagaaacaactaatgtagatgacgggttgatgggtgcagcaaaccaccatggcacatatatacctatgtaacaaacctgcaggtctgcacatgtatcccagaacttagagtataattttaaaataaaagaaagaaagaaaaagaagacatgctcccatgtgttaagcgggtttcctgcagaggagggctcatttttacataagattcccaaagcagcctccttatatccagagtgtcagagattttacttttcttcttcttttttcttttcttttttttttttttgagatagagtcttgctctgttgcccagtggcgtgatcttagctcactgcaacctccacctcctgagttcaagtgattcttcctcctcagcctcccaagtaactgggattacaggcgtgtgccaccatgtccagctgatttttttttttattttttgtagttttagtagagttggagaggctggtctcccaactcctggcctcaagtgatctgcctgccttggcctcccaaagtgctgggattacaggcgtgagccaccacacccgactgagagtgtcagagatttgtcaaagggcctgcaagtatcctggcctgaaacctcacaggctgcttctgaatgataaaaactgacctgtcacttctgcaccattggtttctggtcttccatcacttccagcctcgaagggtgctcccacagcttagtacctgcataacaaaccccttaccccagcatatctaggatgccaacaactgtaaggcacaccacaagagaaaatgtatgctgccaataaatgctgacgtgttatctattgtaaagaagcatgcaggccctggcagtgttgaaatgtgaaaatatgcacatccagcaatcaaaacacctcatgcatactacaatattaacagagattgttttagaattatgaaatcagggccggtgctttggctcatctgtattttctaaactttctatggtgaacgatattactgccaatatttgaaaaatggtaaataaacattattttaaacaaaaaaaatgaaatgagccaaccagaactaccatgaacctaatgaaactaaagctttgtggccttccaaaggcccctggaagaagccctagtttgtttatatttgtattttttgttatttgtcataaaacaacccctcaaactacacatgcttcaggccccataaagctatgagctgtcttggattcaacaaatatggagtacctaacaagtccacgtggactgctttaaaagacagacagaaatagaaacatttcagcttaagtgaggatacaagcaagcccagataaccacaccaaggcaacaagaccaataatccctctccctttcctaattatcactcctgctgctatggactgaactgcgtcctcccaaaattcgtatgttgaggcactaaccccaatgggatggtattaggagatggggaggtgatcagggatagatgaaaccatgagtgtggaggccccatgttgggattagtgaccttataagaacaggaagaaacaccagagctttctgtctccaccatgcaaggacacagcaagaaggtggccatctgcaaaccaggatatgagccctcaccaggaactgaatctgcaagcactttgacctgggacttctcagcctccagaactgtgagaaataaatgtctactgtttaagccacccagtttatggtatcccattagagagcagcccgagctgactaaaacacctccatactccatctctagtgattataactggtgatgcacaaatccactggtaaactgtcagatattgaagccaccaccacgctctatagtttggttctgttgaagttttataagtaaataatgaactgccaatgttgtataaatgctatggggaatattcacccaaggattctttcttttctctgaaatctctcatattctttaaaaagtcagcctcttttcatctgcagtgagattttctctctaaatccttctttaaacactctttttgtgtgacgtcttagccttaagtactgagccttaaagaaaagctgttttccactcactgccttgttttacatatgctctccctgagctttcaaaatggcaaaataaagcatcttagggaccacaagggccgcctgctttgaactacccagcagtaaaggggccaagtgacaaagctagtcggtacacccggcccaaagcaccctaaagccaaacacaacacaacactttgtcaaattaattattaggctgcatcaaaatatgaagccactaaaagtggatgtactctatttgaaaaggaattttaaaaccctaaggttccacggaacctagtttgaaaaccattggtcaacattagcaagaagcaaacaaaatgaggaatttttccctctgcaaaaccatgtcccctccaccttctccgtggagggaagacacagtgttgatacacatacctgccatgatacaggggagagtgcatgacacacatttaaaaaggcgtggggtgaacaggcaattctcattttagcaagactgttagaacttcattcagccaatgatgaacatgtgctccactttgaaaacaaaaggcagccttgtctcacccatgactctctgtccctattccacaaggagcattcccacccaaatgcaagctctcagcttcatggacacgctaaggaggctctcaccaggagcacctccgagtccatgtccacatctctgcagtatggccccagccagatctggagcacattcttgtattcaacacatttataaagtgcctcatcaatacctggcgctgttcttgaccatccgtgaacaaaagaaacaacaatctcacccttgcagtgtctacattctagaggggagagacctcctaagtaattaaattgggcacaaaagaatgatgagtgctccgggggaaaaacagagcccagatagggggagcagggagtgctggggcaagtgttttgcttctgtttcggtttttatgtggtaaaaaacatgtaagatttaccatcttagccatttttaagtgtacagtactatagtgttaactacatgtaccctgtttgacaacagatctctagaacttcttcaccttgcaaaactgaaactctatatccaatgaacaactctcctttccccctccctccagcccccggcaaccaccattctgctttctgtctctaggtgcctcgtatgagtggaatcattcagcatttgtctttctgtggctggcttatttcacttagcataatgtcctcaaagttcatccatgttgtagcctgtgtcagaatttccttccttttgaagactgagcaatcttccactgtgtatacagaccacattttatgtatccactcatctactgatggacacttgggtagctcccaccttttggctattgtaaacaaggcttccatgaacataggtgtgcaaacatctgttcgattccctgctttcagtgaagacctagttttaaacagagctgtcagtgtggttccatgcctttcctttcctctgcagccctctgtccaccttctctgtaggggggaaattcccactttagtctatttcctggcactatttcatcagtagctatgcaacccacacctgcattttcagaacaactcccacaaactgcagaggactcaatatcacctattttctaaagatggatttcttcaaagcacagggctgttgggaccagagtgcaataaaagagtgaggaatggagaatgaaaacatgaatcatgaacgtgagcagctggctctgttttcagaggcacttgtcagttcccccaaaagacagcccctcatcatgtccttcaacacggcaggatagacaggacaatgtcacccatgctcccaagggcccccctgtccttactgcctaggaaagaacggccccttgatggaatctctgtctgcatgaaaacctaccacgaacactttcttcaaagttctggaaagaaaagttttgacacctgttaaaggaatttcaagaattcaaaattaagtggggacttcccaaagtctcaaataatcatgacacaacctactcaaccatggaacaaatcctgactgcggagcaggacccccagctagacagtgcagagcagccagagtgggtcagacctgagtcctgacccgaggactgctttctggaggtagatatgagaccccaaatatgaacaagatgcactagggacccaggaaccaggagtgctgatatccaaaggtcggggggatgatggatgtcccaattcgagaagagagacagaacgcacccttcctctgactctctgttaagactggcaacaaatcggatgatgaccacctgcattggtgaggatgatcttctctactccgtctactgattcaaatgctcatctcttccagaaacaccagctatctgggcatctgttagcccagtcacataaagttaccatcacaaaccacaaggaatgaattctgctggcacctgaatgagcaaggaaatggattctccccaagagcctgcagaaaggaacaagaccttgactgtaatccagcgagtcctgtgttggagttctaatctactgaactaaaagaaaataaatgtgttttgctttaagctgttaaatgtgtggtcatttgtaacagcagcagcaggaactaatacagccactttaatgagcagcccaggtggctagtacaactgatggggaatgtatcccctggccatatccccaggtgtgtgcccgagagtatcactgtccaaccaaactctctgcagtggtagaaatgttctatacctatgccgtcaaatatggtagccacttgtgaccattaagcccttgaaatatggctagtgcaactaaggaaatgaatttataatacaggtcatcttaattaccttaaacttgaatagccatgggtgatcagtggctcctacaatgaacagcagagcctcaagcagaggttcttaaatgttgctgcatattaggatttcctggagagatttttttttaatgctgatgcccaagctgcctcccagatcaattaaatcagattgcacttaggggatgggacccaggcattggtatttttaaaagtctccaggggttctaacatgcagccaagtttgagattcagtgacccagggaaacggtcacacagggtacacacagtcagatacatggatggtaactgaacccctgccttggaatgtcaacaaatggcaaacgctaaggtttccattcatgcaatggaatagaatgtccacagcaattaaaataaatgcatggatctatacataccaacaatggtaaatacagaaaacacaaagttgacttaaggagcagaaacactagtaacaatacaatatcatgtctatgaactttgaagtgtacacaacaatactacctgttgactataaacacatatagtaaaaagcataaaaacttggacaagaagaacacacaccaactgcaggctgggggaaacctgctgggaaatgagagcaaaggaggggatgggggggtgcaggtacaaagagcttcacttccatgcagcaatttatttcactttagaagatgtgaagcaattatggtaaagtggtattatttgctgtagctccatgttatgaacacaagtgtgttgtcatattttctctattcttttctgggcgtataacatttttcataataacaaaagagaccaacatatggatctccaggcaggaagagtttatccctgggcgggcagcacagaggagggtggttctctggggtgagttaggctatgtcatattgaggaatttattcctagtaggttttccttcaaatggaaagccaattgtcttccagaatttaaggaaataaaacaattatgagccaaaaaaaaaaaaaaaaaaactactggacaacaaaatctggccaaaggtgagtcaggcaaaataaagaagttagaaatggccttagtaaaggcagcatggcagcagctcaggaggaggagaggcaggttggcagggttctctgagcacttaaacataagactatgaggaaataccacaggaagcgggggagcagcggagagcaaatgctatcaacctcatcccacacatgcaacaatttgcaacaatctagccacgggagggaaatgataatattagtgtgccagacactgccctaagtgctttacattataaattataataactcaactgttagaataattctacaagatactgctattacttctatcttagacgtaacagagggaaactgagtcacagcaagtttggtgattagcctgaggtcaagtggccaagatgggatttgaacccagctgtctgggtcccaaatgttaacccctacattataccgttctttgaaattaggtatgcctgcactaatgtcctctgcgcttctacacttgaacttcccgttgtaaaaaaaaggactctaaccacttaaaaaattctatagccttttctacttgactgtgaagcatattcatattctttttcttgttaaagtaaatttcaaacttaccatttatcctgaaagtaaaatgtataatatataactctttggacacacatcctccctttacatccatgaacagcgtgatgtcgaagtcccgctcaccaatgtctatgaggggttatttgtgaaaggtgacattttatgtcatttttcttcttctgtttttccctggctttactgaggtacacttgacaaataaaaattccatgtatttaaggtctacaaggtgatgtttttgtattcaccttgcaaaataattaccataatcaagctaattaacatgtccattacctcacatagctctgatgttttgtacatggggcgagaaccgcactgctgggtgcggtggttcatgtttgtaattctaacattttgggaggctgaggcaggaggatgggttgaagccaggagtttaagaccagcctgggcaacacagcaagaccctatctaattaggcatagtggcacatgcctgtagcagggagacagaggaaatgggtaacttgagcccaggagttggaggctacagcgagctatgattgctacactccagcctgggtgaaagagtgagacctagtctcaaaacaaaacaaaacaaaacaaaacaaaaaaactactctcttagcatatttcaagtccacaacacagcattctcaactatagtaaccatgccgtacgttagatcttcagaactcattcctcctgcataactgatacttagtatttttattctttctacttttctgtattgctggaatgttttatagcaggtattcataaattttcacaacaaatgttcagttaatgacatttctaaaaaaacaaataaaaaagaaaataccaataaatgcacctcctatagaaacacaaggaaaaggaggcgtgccatggacatgaggagggagaacacacctctacatctgtaggacccaggacagtccttctggacccgcaacccagaggactgcaggcaggcagcacctccctgaatccagggtagacagccgggaagggcaggaggaaggccacaggcatggagccagatgaggtcaacaggaatgccatggagacaacagctataaccacagggggaaacccacgctgaaggaagtaaaaatcagaacctacaccctggaaaaccaaactagtgacacaggggaaagcttcagaaattctcccagaatgtcaaaatgaaaaagaccaccacctgacaaagcctcttatggcaagaacagagaggaaggtcacagatgacaaggacaacagagatcaagggcgtttcaagaggaactgctaactcttttccaaagaaaggtgtgcactactgcgacacaaaagcagacccttgctctatggaagaaaatccctctccaccagtgagtacttcagagactgcctgaaatgctccccaagctgttctcagtaaaagcaccaagtcctcttaccaagtcaggaaaacaagcctgcatatttatttggagcactacatttcttggtattctaaaataatatacacctctttctctctctctctctctctcacacacacacacacacatacacacacagagtagataaaaagtcccctttaagctaaagttgggagctcaagtacaacttcaggattatcaataaatatacagctgaccttggaacagcacaggtttgaactgggcgagtccacttatatgtggatttttttccatcaaagttacactgagtgtgcctgcctctcctgctgcccctcctacttcctctgcctcttcctcctctgccaccccgagatagcaagaccaagccctcctcttccttttctactcagcccactcaatatgaagactacaacaaagatgaagacctttatgatgacccacctccacttataaatagtaaatatattttctcttccttatgattttcctattaacatttcttttctctggcttactttattgcaaaaatacagtatataatgcatgtaacctacataatgtgttaattgaccgtgtttattagtaaggcttccagtcaacagtaggctattagtagttaagtttgggggaagtcaaaagttatacatggatttctgactgtgagggaggttgggtcccatcagggctctgagcccaggctaagccatcatatgccctgtgacctgcagtatacatccagatggcctgaagcaactgaagaaccaccaaagaagtgaaaataggcagttcctgccttaattgatgacattccaccattgtgatttgttcctgccccaccccaactaatcaatcgacctagtgacattcctcccctggacaatgagtctcaaaatctacccaccctgcaccttgtgacccccgcccctgcctgtaagagataaccacctttaactgtaattttccactacctacccaaatcctgtaaaactgccccactcagcccacttgcattcaagtaaaataaacagccttgttgctcacacaaagcctgttggtggactctcttcacatggatgcgcatgacgggtcccctaacccctgcactctttgaagggccaaatgtgcattatgtgacatggataaaaattaatgtttttctaaatggcaaagtctacaacctacaaattgaagaatagttctagcttcatctgaagtgttattgaagaacaaaaataatattctccataaatatagcaggcagatatacatttttaaaagtctcaactaaagctgaccaatgcaaacaattatttatttaggtgatcaaatagcaaactgactgtcagagacccattcaacctgtgatatgtgacctatgaattcactttctaccttcatgcttccaaaattatctagattactcactatcaatatttttcaccaagaaacaatggaatcctgagtctggtcacctgaccctatattaaattgtacccatcaattctacaaaacactgcccatgtttcctataaaaaaaaaaaattagaagaataaaagagtaatccacatacaatgtaaagctaaaaaactgcattggaataaaaaacaaaattgaagtattttatgaaaacctacaagaactaataagtgagtttaggttagcagggctgcagaatacaagagcaatatacaagatgcaactgtatttctatacactagtagtaagtaatcagaaagttaaatttaaaaacaataccatttacaatagcatcaaagtctgtaaaataaataggaagaaatctgacaaaagataagtaactcctgtacactgtaaactacaaactactgtagagaaagattaaagaccaaataattgggaagatataatgtattcatagggcagaggactcaatattattatgacatcaactctccccaagttgatctgtagaagtgcttttcaaccacgggtgattttgtcactccgggagatatttggtaatgtctggaggcactgttggttgtccctacttggtggcagaaggtactgttgccatctaatgagtaaaggatgggatgctgctacccaccccacaatgcagaagacagccccacaacaaagaattatccagcccaaaatgtcaacactcccagtgccgaggtggaaaaatcctgatgtacagagttagtgtaattccaatcaacatcccagcaggctttgttctaaaactgacaaactaattctaaaattcgcacagaaattcaaaggatatagcatagccgcaacaactttgaagaagaggaacaaagagaattaacataacctttcaagaggtttcaagaattaagtcaaagtatgttaacagacaattctccatgaacttctgcatatgtggtttttctaaacaagcagcactgtaaaaataaggatagaggatttgaatgccttgaaagctagaagtagtataacgcccaggagagatttagagacatatctgtcttgcaaccatttgctacctttcagtaaaataaaactagggaactttcctcctctccccagagaggatttgtttagattgcagagtaagagtctctccctctttgtctctggggcagaaaaagggcaaagttattagacaccctatagcaattcaggggcctctcctgaacagcactgcacgcacaggggagtaagtggcactgaccacactgtcccttggggaattgacactagttggcactgtgaatataaaatatttcctctgatccagagacattgttcctcatcagaatatatacatacacttaaacacacacacacacacatttttaaaacacattaattaagacagtgtggtgttggcatcaagacagacaagtagaccaatacagtataatctctactgcagaaatagatccacacatatacagaaaaaaatctttgatagaggtgcaaaagcaattctgcgaggaaaggatagtcttttcaacaaatggtgctggaaaaactggatatccatctggggaaaagatgaaataaacctcaatccatatctcataccacataaaggagttagtttcaaatgaatcacagacataaatgtaaaacatgaaactataaaatctgtaaaggaaagaatggaaacaaatctttataactctggattaggcaaagatttattacatatgacaacaaaattttaaatgtggcatcttcaaaacacactgtaaagggaatgaaaatacaagacacattccaggagaagatatttacaaagcatatagctgatacaggtcttgtacctagaacataaaaagaatcctcaaactttaataaaaatgatgtcaacaaaaatgccagagttgaagaccaatgaaaattctctcttccataaaatcaatgagaaaactggcagaaagtgtcagaatcaactttttcagaaccctaaaaattaaaaacagattgcagcaatctgatgagtgcttcctcaagaaaaatgtctgaatctcggtaagaacaggtgagctttgtggcacattagcttggtgctattcccttcccacctacccgtctcggcaggagccttgcaaaccaatagcccacaatcacagtgcatgtgagaaccctggcaaaacatggctggagctccttcaaattctcattcccagagaactgacatgaaatgacctgtctgatgtttctctagaagaaaccacctagaaggctgtttttatttgacctgactcagaccttgctcagtgtgacatgtctttagcctcggggcatttgctgaaaacagttgaaggtgatcattaaccacaacagctgctagaggtggtggttaacaaaaaggcaaaaagaggctaaccaaaaagcttaaaggaaaaagccatggaatgaaacgtctgtaggtcctttgaaaaactccaataaagtgctgaaaattaaaaggccacatgcacacaggctgtgtacatgccaagcactgtgttcatgctcaggaaaggcctgggaaggccctaagctctcatctccgactgaccttgaggctttgcacaagcaggaagggaagacgaaggtagggctgtcaactgcctgcctggctgagtagtaaagtaacatttgcagatgacttccttagaaaatcttaaggaatccacaaaaatactgttagaggtaataaatgagttcagcaaggtttcagggtacaaaaatcaatacacagaaatctgagattcctgtacatgtgcaataaacaatcaaaaactaaagtgaagaaaacaattccatttataacagcataaaaaatacaatacttaggaataaacttaacaaaagagatataacttgtacactaaaaactagaaaagatcattgaaatgaattgaagaaagcttaaagaaaagacatcccatgcttctgagctggaagacaatattgtttggatggcaatattctccaaaatgttctacaaattcaacacaacccttataaaaatcccagctagatttttttttttttttttttttttttttttgcaaaaatggacaagttgatcctgtaattcatacggaaatgcttggatccagaatagccaaaacaatcttgggaaatcaaagttggaagattcacatttcctgatttcaaaacttactacaaagctactgtaataagcccatacatttatagtcaattgattttcaacaagagtgtcaagtcagtataatgcaaaaggaacagtcttttcaacaaatggtgctgggacaactagatagccacatgtgaaagaataaaattgaacccttgtctcatatcatatacaaaatttaagtcaaaattgatcaaagacctaaatataagaggtaaaactatgaaactcttagaaaaagatatagatgtaaattttcatgatgttggattaggcaatgttttcttagctatgataccagaagaacaagcaaacaaaaaaatagatgggatatcatcaaaattacaaattttgtgcttcaatggacaccatcaagaaagaaagacaatctacaaactggaagaaaaaaattgtaaatcatatgtctgtacaggtctagtatccaaaatacataaataactgttacaactcaataataaaaagacaactcaattggaaaatgagccaaggatttgcatagacatttctccaaaaagagatttgaaggaccaataagcacatgaaaagatgctcaacatctctagtcaggagggaaaagcacatcaaaaccacagcaagaaagcacatcacaatcacaaggatggctgtaataaaaaaaactagaaaatacatgtgttggtgaggatgtgaagtagaacccccacacattgttggtaatgttacgggcaggtctttgttcttagagctcccaagatgtggcagaccactcccaagatggcagcaagccttttgttctctgacctggggttcttggccttatggattccagagttttatagctctattagaagccgtaggtcacggaagagaaccatggaacccagcgactagtgttcagctcgattaggatgaacctgggcactcagccgtgcaggaacaatggcgagcctttagcccagtcggaagcagcaatgggcgcctcgctggatcaggagcacagcagacaccctgccagatctagaggggtgtcagtcagtggcaggtctgcaatggcagccaacagcagtggtggacagcgagcgaaagctcagctcaagccataacaaacatggaccagaagagtgtgcagttgcaagatttaatagagtgaaaatagagctcccatacaagggaggggacccaaagggggttgcccactcccggctcgaatgcctgggtttatatcccgatcattgtccctccccctgtgctctcaggcgatatatgatttcactatttctttacctcttgctttagcctagtttgtattttagtgagccctctttactacctgattggttgggtgtgagctgagttacaagccccgtgtttaaaggcaggtgtgatcacctttcccagctaggcttaggaattcttagtcggcctaggaaatccagctagtcctgtctttcagtaagaatgtaaaatgaagacactttagaaaacaatttggcagttcctcaaatggttaaatccatagttacatatgacccagtaattctattcctaggtacatacccaagaactgaaaacatgtgttcactccaaaacttgtacaggaatgttcacagcagcatcacgcataacaaccaatgtccatcatgcgatgcatggataaacaatggaatatacaactgtttactggaatactattcagccataaaatgaaataaagtattattagatgctcacaaaatagacgaacctcaaaaacattttgctaaatgttaagaaaatagaccactaccaaaattctttcaagaggtaaatgagtaacaaactgtggtgtagccacccactgggatactaccaggcaattaaaggggctaaactaggcacatgaaacaacatggatgaatctcaaaggctttatgctgagtgaaaaaggccagtctcaaaaggttatatgcggtataattccattcacataatattccgcaaaagacaaaactatagtatggagaactggtcagtagttggtggctggcatgggtttgagaggggtatcacaagatgaagccattttacaaggtaatgaaactggtctctaacctgattttggtgatggtaacaggaatggatacatgtattacaattctcagaactgtatacccagaaaacaaaaataaaaacctaaccacaaacagaaagtaaaaacacagaaataaggccctcctttcctgacatgcacattctttagtaactacgaaagtaatttcttcaacttcaaaaagcacaagtttaactgatttatttcaagaatgagctaatcaattctgtatttattaaatgcaaatgtttccaatgggtagatttaatatgctatggcaggagaaaggtacattctataccctgaagtacaagaattgattgtgcaagcttggatgcaaaaagtaaaattaaaattccatgtacgtgatatagtgctacacctggcaaaaagcttttctgtagagtgaactgaaaggcacttgcaaacaactcaatcatctggttaaaaaagaaaagaaaaaataggatcacaactctctcttgttacagggaaagtgtccatcttccaaaaaccaaggctcccctcacgcttctcaaagatggtgtccctcttggacagcctctgactctccacatcattccctctttcctccaacccccactgataaattcccaccttagaggcaagccacagcccacagactgctacttcttaatctccccctgtacagagtattttctttttttcagagacagggtttcattccatcacccaggctagggtgcaatagcgtgatcatagctcactgcagcctcaaactcctgggttcaagcaatcctcccacctcagcctcctgagtaacagactataggcacatgtcaccacacctggctactataaaaaaatttttttttttttaaagatggtgtcttaacgatattgcccaggctggtctcaaactcctgggccatagcaatcctcccgcctcagcctcccaaagtgctgggattacaggtctgagccactgtgcccagcctggaaaggatcatgtttgccccataccttcccatctttccagtcgtgccaacctaacacccccagagaaccatgtctgcctccacactcccactctcccttccatcactcccatctggcctcctcactgattttccacaaaacctgtcctcaaatggtcactaacgatctccatgctgtggaatccggggggcacgtgtttgtccatttgctcagcttctcagttgtcaccaacccatttggccacactttccttctgctgatattttctgctttcaacatccttgaaaccacaccctcctgcttttcccccagatctggccacactttcttggtttcctgtggcagctcagcctgctctcctgagcttctaaatactgaggaaattcctcatggccaggccatgcccccgtttctccacactcttcaatttgttgcctgcctgcatccaatgccatccgtatgcacctgctcgctctgtttcatcggcccaacctttgctgggtttcaggacattttctaattagtctgtgagatctaagtagatgtcccattaaaaagggggttccatgggaaaatacctttgagaaacactgcttcacatgatgccccccagccaccccacgatcagctgatgagtctttaggaaaacaaatctgtctaaaacattcctagaaaaataatcccaacaatcaatagtttgtgtccctgttgtaggctcaggtatttcacaaaatccttctcatcttccccactgaaatttagtctcgtgtgaaatgaaacacagaatttactactttactcctaggtaattcccaagatcacctgcctcacttcctccccagggcacaaaatcagagatgtgccaacagaaggcatccactgcagaccctgtaatcttgccaccaccattcttcatgagccatggagaagcttatagaagctggactcctctccccagaaaaataaacacacacacaacacacaaggatctgtatgtaatctcaaggtctcaccccaggaaattcaccccagggtccatgaattcaaagtaagcccccctcagtaaggatgcttcagcggacccctctgattcacaggggtctccattctcacgggcttgctggtttcgctgctaagattatgacaaactagggctgatgagaccttgcttcactccagcaacacaccagtgcaccataactgaggcctctctgcacacatccgccctgcagacaccgtgcattcatccatttggcaaacactcactgagctcccctaccttccaggtgctgtgctaggtgaaggtgacaaactccatgatccttgccctggggagcagacctcctggtgaacagacgcaaacaataagcacaacaaatgacaggttgtgatggcattataccaaaattcaaggggtcatctgacggggtcagatccttgatattgggtggtccgtagtatcatgtgacagcatctgagattgcattccataaaaatcccatcaagatttgtaaaacctcaaagtccttcaaaataagaagatacagtctcaatgttaaaggctgaccaaaaaaaaaaaaaaataggatgagttggaagagaagctgcatgtccttccaaactaatgaagtgatgctcctcctcttggctccccactcccagtagaaatccagccgctagtacccaagtgagagtgacacattcctgcctagcaagcctacagtacagaccatctggtccactggccttgtgcccacttgaaagataacaagccagtttccaatgataaaggaacccaaaaataaagatgtaaaaacagagcccctgaaatgagtcaaatgatacttcctcaccaaacacatcttctgatagcaaatcaagtccaaaggtctcattacaaagaactgtaattctagatagtaggattagctccaccatgaaatctatatgccaacgctctttcgtaattcacttaaaggcccactcacaggtaattcacttaatttcagatctctgcacttgaaaatcacattttttgtgtttcaaatggaactgtctaaactccatccatcgcagaacagttatatagattatgttcataaaattttgtatatacaaccattaaaaataactgggtaaaactatgttactcaagtgatatgtattgttttatctgcgtaaaactctattcttcttgtaaattctcctttgtcccatgtgattgtacttgaaacttccaattatactctttctagcccctccccagccactgtggctagtccagagataggaccatgacatgaaaccagcctatttgagtcttccctgggattctccaacctgcaaaacaaaagcctcttgcatgtccggtcaaggagctgtgggcacataagctcccaagagctgcaagtggcagagggtccacataaaggtggggttgtgagggcgtggaggggtgtgtgagggtgtggaggggtgtgtgagggtgtggaggggtgtgtggtagctaatccagtaaaggcacaggaaggctacgcctcactcagtttctgagtatcttctctatgaagtcaaaagaagtttgaggatgattggtgccattggtgaggcaggttaagcatggttaggactggctagtttgaagaatccagcagcctctgggctggaggggctgtcatgagttgtctggtacctggctctgaggtgtttagggctggtggaccgtggcctagaaggtgagagccagaagaagtgctggggaactgggctctaggctggctggtttgcattctgaaaggctcactcacaggtgagccattaccacctgcaggaatcagctagcctgggagggacagtccctccagcatcagcaaggccccagatgccagagcacccaaatatacagaataaaagggcacaatgaacacacaccaaaaccttgtctcacagagaatgacacctagagtggctgattgacttgaccaagctcaaatgagctaataaaatttctaccttagggtttacacagcacttacaaactacctcattttagatatagcaaaaactctaaaacatcacaggtttatggccattctgaatctcaggaaaaccgaaggtcagagaagttaagcggtgtttctttagtcatctgactaaagacaaacagagctaaaatgaagctacatcttcttgtctagccttttgcatggattcttcaccacacggcctctgcagacctcaggccccacctaaagctccattctgatggatgaagcccagggcccctcgtgcttataagtcttggttggggtggtctttcccgctcacatctcccatgctcggatgtacggaaggcgcctaggtggggaggggacgctccagaaaatgcaaagctcttccgaacaaggctttagtatccacctgcagctgccttctcaccctagggaactggactgaacaacttagtgctccctgagcctcgcccagagcaatggttctctgggaatctgtgcgggtgctgggttgtcataatggctgtgtagttcctgacctatggggaaaagtggccagggatggtagccatccatctatgcaaggagtgttaacctttacgtgttaatgtaggtgaaacaccaacttataataatcacaacctaaaacttgcttccacttttaacctccaggagttttctcattgtttttatatacactaaggtgcccggcactgcaactaccagatcgatcaagcgaactccaacgtgtctggaactctaccaagagcggttcaccactttggaaaatcatgtccccattgacaaggacactccagtgcaacatcctgtcctgctgtgcggctgccgtcatgtctgtggtgatgggtggaggtgcaagcacccagtcgttccctgtgtctcccagtggtcaacatgcctaagcacagaaacatacattattttcagtgaaaattacatttagggctttgtaatgctttttggaatcgtaagtgagaatacggtgcactttctatgacttccatttggggatatagcaaaaacatcatgacaaagggctgtggatctgacagagttccaaccacaggcccagagcagactctggccagacacctcctgtagcctttcctttgagccctgtccttgatctcgatccagttagcatttcaaggttcaaatgcagacccatcccaaaacggtgccgcacccaagtctgggaccaatgacggagagaagagggaggcacctgcctgcattcttcccctcagtggctctggccacacatggagtcgtgggctcccctgtgcactgttctcagcctcaggtaggctgtgttctaccttccccccagttttcttcttacctacgagggctcttgatttctcctgactttgcaaatcctttatgcgtgacagtctcgccttgagaagacagggaggtaggggacgggaagccagcaattttacccactactgattcattcaagaaacacaaatctgaatgcctactattcattttaccagggctctttgcagacacgccagactttcaaactagccatcatcatttaacatctttcaggatttcacattagaagcttttggtaactgaaagtggactggtgtgggggagggccaggtcccactctgacaagggcctagaagacaggccaactcctgtctgaggtctgaaactgggcagaacatgaagggcagccctggggagggccaaccatggggacggaaggcaaaaggctgtgggaaacccatttttaaattttttaattcatttttaattgacaaataaaaattgtacatatttattgtacaatttgtacaactgcacgtacttcaacatgttgtttgaaatatgtaaacattatggaaagcaaaattgtttctgaggcagggtctcactctgtcacctagactgcagcgcagtggcgcaatctcggctcactgcaacctctgcctcccaggttcaagcgattctcctgcctcagcctggggagaagctgggactaaaggcacccaccaccacgcctggctaatttttgtatttttagtagagatggggtttcactatgttggccaggctggtctcaaacccctgacctcaggtgatccacctgcccctacttcccaaagggctaggattacaggcgtgagccaccgcacccagcttgaaaggctaaactgagctaattagcatatgcattactttgcatccttattttttgtagtaagatcacttaaaatctactcagcaattttcaagaagacaatgctattaactatagtcaccatgttgtacaagagatctctttaacttcctcctcctatcgaactgaaattttgtatacctcagattctaatttttaccctatattacacagagcaattttgaatttatttcgctaaactgtgacctagagaaaatattttattcagaaaacatcactggtaaacaaacagctcaggaagtgatctgtgtttactaaaactttgaaatatattttacacatattctgcattaaaatctgattaaaatgtagttatacaaagagacagtgttttctgatttgtagcattcatggccgagatacactatttaaaaatgcacttgatttaggcatttattcaaaatcataagcataaaacatgatcataccttcctactggcagacacaaaactggtgcatcccacacacttgtttgagtaattacaacaccagctgttctagcacctaccaagagaagctgcaactcagactgactcctggtcactgatgtgccaaacagcatcatcttctaaccaaaaatgaaaatctcactttgataaatgggttgtccaagttaaattagctaaaccaatgcttaagtctaagttccaatttttaaaactttctgtatatgctatactagcaaatgtggatttatctgattttaacacaaaaaggagagactgccaatagaattgatttctgctagattttaaaatctacaaaacctgagatctccccaagaattaaaggcaattctcaggttgaaatatttatgaaacatacaaatttcaatggcatttcacagaaaataaatataaagcattaaatagcaagacaaagattacagccaagactctcaactatccaactgaaactcacttccatatttaccacccaaagacagcagaccctccatgtgctggagcctctacaggaggaaggggaaatggccatgtgctcagtgtgtgttccaatccagggattgtacacaggctactttattcaattttctctgactctggatttcccacaggataggcttcgtagcagcactctacagttggggaaactgaggcctggcaactcccctaaaggctgcccagccaggaagcacccgcccagcaggtctgacgaggcctccattctcttgcagtgcgctatgtctatccactccaaaagccacagcacacacaacttcaactctccagaaaatgtccagtcaccctgtctatatttttcttgtttcataaaaattacgcattttggttggagtagacttatgaccagaaagaggctctctgcaaagcagatgctgcacttgcaatggtgggatgaagggggatggaatgcaatagcttgaaaagtgaccgggacacagcagctggactagactcggggataagaaatacctctctatttttccccaaagttaaatatttctaagcttccacctgttcacctggtgagaaatagcatttcttcatggagtacaagagtcttaagtggtatatgcaacccagaaaatttggcaaacggtccatgatgatcaccattgagctccctgcccataaggtccattgtagaggccctgaccctggaaagtgttctgtctgcagacatctgtggccatcctcaccttggaatttccccttcttagacgagccagtctgacatcagtaaaaaacagaagtcaggcatttctcccctgtagaaagggaacctcccattctggcagaccaagattcaacactctcttggaaaggaagaagggaaataccactcatgcctgcaatgagccaacagcagaccccagtaggcccaaacaatgagaaacaggacagagtttgggtttgctttacatctattccattgtgaaatgccagggccccaggactccccacggctcaggaacgtatggagacgcattaggtggcaatatgtgctgctgcctatagaaacgatatgtgacccacagaaagagtgtcatatgtccaacctaacaccacaccagtgggtcacatctgcaagtgccccttggccaaaaaaaaaaaaaaaaaaaaaaaaaaaaaaagaaggatatgtagccttgctctccttcctaatcaggagctcaccggaacgtgggagccaaccaaaccaaactgtggctccagcttttacaaccctaactactgggaatctattttctcgctggagtgtctgagaggatggagaaatacacactaaaaagggttccgtggagatattggatttagactttataaatgtggctcatgaattccaacacccaaaatggaaaactgggcttccaggatattatactgttttgtacttagctactttatttatacccctcctggttctgaagaatatttaacaggttttatttcaccatgaaaaaaagggttgctttagcaacagggcaaacaagtatacttcttaaatgtctataaatgacccagattagtctccaagtttgtaaaatacttaatctctttcagcaatgaaatgccaagataagagtaaattccaaaaattcttttgagggcatgagggcttacttattgttaagtaggagatgagctaagcctctggtactctcggtccacagaggcaccctataaaaacgtggcaagcccagggcgaggcatcatggaatggaccctgaattctacctcagtggtgccaattcctgagaccttgttaccacaatgtggccaggcacaaagttttcactggccaagacaaaaataagaatagttcccagcacaaaaaaaggcaccaataagtatctgtagactgatggactgataagtgaatgactgatactgtatacttttcaaaagtcaagagataatttattacatgtgaagaacaatccttaaaaataaagctggggccaggcatggtggctcacgcctgtaatcccagcattttgggaggctgatgcaggaagatcacttgagatcaggagtttgagacagcctgggcaacacagggagacctcgtctctataaaaaaaagaacttaaaaactagccgggcatggtggggcaagcctgtagtcctagctgctcaggaggctgaggcagcacaatcgcttgagcccaggagttcaaggctgcagtgggctatgactgtgccgtttgcactccagcctgggcaacagagcaagacatcatctctaaaaaaataataataaaaataaagtaaaaagctaaagttgaacctgagagtgtcccttataacattctcctaataaaatctttttctttgtataataaaatggtgtgataaaagacaatagtttcagtgtgaataaaaactaaacagtaaggccaggcatggtggctcatgcctgtaatcccacaactttgggaggctaaggcagggggactgcttgagtcttgagcccaggagttcaagactagcctggtgagaccctgtctctacaaagaaaaaaaaatttttttaattagccaggtatggtgataagcacctatagtcccagctagtcgggaagctgaagcaggaagatcactcgagcctgggagtgcgggatgcaatgagctgtgattgtgtcactgcactctagcctgggtgataaagcaagaccctgtctcaaaaaacaaactacccaaaaagttagcaactttatgtctgaaccccaaatattcttttttttttttgagacagagtctcactctatcggccaggctggagtgcagtggtgtgatctcggctcaccagaaccccaaatattctcgaactttcattttaactacaaaatctgacagtgtgagaaccactgcttgaagcactggctacaatcccaggaagaagagtggaaatccaagacacaggggctagtcggaaaacattccccaaaggcagggaggcagacccaggcggcagaggagcctgcccaacagccacgttccctcttccctcggacagatccccagctttgttagaggatccttttcccatgtgactcaaggtcaagtgaatctacctcccactctaagaaaaggtcagtattagctaattccccttgccagtgattggttcagggatgatcacatgacttaggtctgaccactgaggggaagtctggtggggggcttctaggaaagatttccttgccactaagaagagacacagggatcagtaacccctcttcttttgtgtacatgtgtcctctgattctggtgcctaaaactacagcagccttctagctggattcaggttaaattaagatactcttaccagcagagcagaaagatggaaaacacatgggtacttgataatgtcaccgaggcactacattaaccaactggaaacctgttatggttgaattctgtcccccataaaagatacatcaaagaattagccaggcatggtgacatacgcctgtaatcccacctactcaggaggctgaggcagaagaatcgcttgaacccgggaggcagaggttgcagtgagctgagatagtgccactgcactccagcctgagcaacagagcctgactctgtctcaaaaaaaaaaaaaaaaaagtcaaagttctaaaccctagtacctcaaaatctcagaatcggagtttatttggaaagaaggtctttgcagatttaaccaaattaagatgaggtcattgggtgggctctaatccaagatgactggtgtccttataaaaaggggaaatttggacacacataccatagaaggatgtggtgaaaacacacaggagagccccaggtgaagacggaggcagagactggactgctgagactgcaaaccaaggaatgcccaaggactgctggccaccaccagaagccaggagaaaggggaggaagggatctatctacctggagtctcagagggagcacagctctgttgatgccttcaggttggacttccagcctccagaactgtgagagaagaaatttctattgttttaagccacctaatctgggcagctctagcaagctaatacaccttctttcttctggacctttttatgtatacgtaacataatatatgtatactatgtaaattaataaattttccttctgcttaagccactttgagtgatgatgtcagtaattgcgattgaaggcaactcgatcaactggtcccaagggaggggactaccaagcagagaaagggtcctaaaggagccaatgcccactagagtccacgcaccgctttaaccagccagcaccaacatccttccttcatcccaaactcacaccgccagacacaaacacaaattgctgctccacacagcatgccgttatccttatatatacaaccaaaagcacacaccacaaattctagaacaagtgcaggacctcaggagaggtccacttcccctttggtttcctcctgattcttcttttagtctaatgtagagattaaactgtaaagctgaggaccagccacgcaccctatatacagtacatgcaaatccaactatttctcctcaaacccttggcctggcccagggccccaccatctctctctggatcattgcattagcctcctaactggaatctccactttgcgaccctggccctccttcaaagcactctacagagctgccaggatgatccggttagaataagttaggtcaggtcactcctctgctcaaaaccctccagtagctcctgtttcattcagagaaaaagccaccgtcctcccagtgactcaggaggcccctactgatggggatccctgtcccatcattgtttcccattgctccccctcttcctcactgcactccgctggcctccttgctgtcctgtgaacaacccaaggcggttcctgccttggcctctgcacttgctctgcccttctccacacttctgcaggtcgctactgaaaaatcacctcattaatgagggcttccctagccatcctttctacaaaggggccttcccaacccctttccactgacccttcacaccccttctcctggatttaacaatacgttttatttatgtggcatgttcattgtccactagaatgcacgctgtaggagggtggggatttttgccaaccttgctacatcccacagcagtgtctgggatagggtctgccacatgcttgaatgagggagagggaggaaagaagaggtgggtgactatgcatgtggttggttaggtcacttagcacggccttgtgttttgtcccagtcatgttcagctgggcagctacaggcctggaggaagcagagagttcaattcagcagggctggagttttgccaacagagtataaggaaggagagaagagccagagagctgaagaggcaaacgatgactgatcataatggctgaactcggaaattattataagttaggtaaagaaggaagtgagggcatgaagagaggacaacatgaaaagataatcaaaggtttatagatcagtgtggggtttaagatcttttgggccgggcgcagtggctcacgcttgtaatcccagcactttgggaggctgaggcgggcagatcacaagatcaggagatcgagaccatcctggctaacacggtgaaaccccgtctctactaaaaatacaaaaaaaaaaaaaaaaaaaaaaggtaggggcgtggtggcgggcgcctgtagtcccagctactcaggaggctgaggcaggagaatggtgtgaacctgggaggcagaacttgcagtgagccgagatcatgccactgcactccagcctgggtgacaaagcgagactctatctcaaaaaaaaaaaatctttctggagtaggtgcacctacattgataatttttgtgtaatctaaaattgtgtttgttcctccttggtctaacaccctcagattccaccagcatatatattagccaagtttgcatccatgtatattagcaaaaattcagttcaagtggcacgtggcatgtaagctttctccctgtggactttataatggcagctgcaccttccctgctggggactgacttcagtctggatatgacaaggggtggtgagggagaaacatcgggagactgccttcccaggtgagatactggggccgggtggaaacgctgcacccgacagaggtcccagcctgcctgggttggcaagcacagttgagagggatcctgagtctcccaatcctctccccaccccccacccccaccagcatccaccagagtgtcagacctcatgcttcctaaatcaacgacagtgttcgggaaccaggcaaggccatgaacacaactgctggtgtgctcagcaaccagaaggatcacactctgaaaccctctgctcctttcttgttgcccccgccttttgtttcagtgcaatcactgcaagttcacgacatgccaggagctgaaagtttcagaatctgggctctgcattctttttctttaagctaatcagcaggagcccctgaatatccaattccccactgcctgccatggacggtgaggagtccaccactcaaccctggctgtactttcactagctctgcccttaaactgggcaaattaccagtcccacatgccctgcccctatttcctggagggtctaccacctgcctccactccttattccaatcctgccttgttctgggttttgacttccaagcaacagaatcaagttggcagagcaaggtggaaaatggcatttacctaaacaatgttggagagggcccagaatcgctaggagggcaaaaggaaaggctgaaggctacagagccaagaacagtgccccacatcctgcccagagcagccaaaatcccctgagtgacaaatgacagatgacggatgacactccaagccaagccctggcgagccctcacaccatgccagggctgcccaggacgcccacctagctgcaaacgtggccaccaacagctctctcactctgtttgcctcactgcctcccaagagacaaagtctaggcagatgtggcccaggcaggccagtggctcccgtgcacccaggatgtatggggatcactcagtttgggtcatatcacagcccattgcctccctgcaccccatactcctgacaccccagcctttctgggacccttatccacagtcttccagtttaaatgaaagaaagtagacctcaaagacaggccaatgtattgaatgtataataatcaagccagggtatccatcaccctagtgtttcccatttctatgtgttaggtacgtttcaactctcttctcgctatgttgaaatgtattatacacactgttgttaactatagccactctactctgctatcaaacattagaacttatttttttctatccaactgtatgattataccccataaatatgtacaaatataatgtatcaaaaagaaagaaagaaagaggccagtggaaggcattcaaaaacaacacacaaacctgacaactctgttttcgcccaccagggctcagtgaaactcttcttaggcatcacacaagagagaaggaaaactggcaagttcacaacataaacacgccgagacaggtagacataccgctaactttatggtgatctggctatctgaatagaaatagaaagagtgctataccatgtcaggagacgaaaacctaacactttgcctgccatctataattgcttgacagcataattgatcatgtaactgacaactgtcccatcatcctattctcaagcactgataaagtgatgtaacactaccaacggcacatgggatcttccctaaacagtgtgatctgcaccaaccagggatcacacagttaataccactggaattttaaaaagctttctctaaacaaaagcatcaaaaagctatcttaaaataaatgaaaagcagacaagttagtcctatagccttgagtatttatcctagatgatgtcctagtggctagtgaactagaaatagactctatctgtggaaatgagggaaatattttttaaaataacaacgcccattagaagaatccagctgccttctcaaaatgacagagccagagcagttctttgtcatcgctatggctcggggcctggggatcacaaacctccaggtattcaccgggtctgcactgaccagaaagcatcactccctccctatgtcaggcatttggacataatgtggatggttaataaaaggcacagcaagctgagaaagactcaccagacccaccttggaggacccaacaactgacccggagcacactgcggaaatttcaactcatctcatctgttcactcgctccttccgtaaatcggtactgagcacctgccgtaggccaagcacggtcctagaaacaggatggacacagctaccaaggcctcagcctcagcctgagggagcccatgttccaggagggaagacagatgagaaacagaatttaatttcagatagtgaggagcatgtaacagaagacaagagcaagcggggaggacacagggcaggaatgcgggctgggagaggggccagccatccagaggagaggcggggagagccttctctgaaagggactgctgggtgagacgtgaagcataagaaggcattactgggacctcggagtcagcttaagggcagaatctcacacccttgtcttagaaaaaaggaatgagaagttttctagacagggaagaaaaggcacccatgcttaaaatgggagggaacaggcagagttcaggtgactgcaagaggccactgtggctgggcacagagagcacacaggagctgcacaagacaggtctgctggtggccacagagccaggacagcgaggtcgtggggaagaaagggaagggctttaagctgctggggctgacacagtcagaactacaacacacacagaaaagcgtaacaggtctttcttcttccaaataagcctatcttttacgcttttctgaattagttggtcctcctgttttggcttgaagtggtagggtttactctattttttggcttgaattggtagggtttattggtttggtttggtttggtttgagagtctcgctcttttgccagactggagggcagtggtgcgatctcggttcactgcaacctctgcctcccaggttcaagcaattctcctgcctcattcagcctccagagtagctgggattacaggcgtgtgccaccatgcccagctaatctttatattttttaagaagggacggggtttcaccatgttggccaggcttgtctcaaactcccgacctcaggtgatccacctgccttggcctccccaagtgctgggattacaggcatgagccagcacacccggctgctttacggagtctcactctgtcacccaggctggagtgcattggcgtgatctcagctcactgcaagctccacttcccgggttcacgccgttctcctgcctcagcttcccgagtagctgggactacaggagcctgcagccatgcccagctaatttgttgtatttttttttttagtagagacggggtttcactgtgttagccaggactgtctcgatctcctgacctcgtgatccgcccacctcggcctcccaaagtgctgggattacaggcgtgagccacggcgcccggccctccttagccatttttaagttacggttctacggcacaacgtacattcacattgttgtgcaaccatcaccaccaaacatgcacagagctctttttatcatgcaaaactgaaactgctcccactgaacactgctcccctgctgtccctggaaaccaccatcctacttcctgcttctatgagtctggctactctgggtacctcatataagtggaatcacacagtatttgtcctttggggactggcttatttcacttagcataatatcttcaaagtctatccatgtcatagtatgtgtcagaatttccttcctttttaagaatgaatagtattccatggtatggagagaccccattttattgatccattcatccaaggatgggttcctgggttgcttccacctcttaactattttggttgatgctgttatgaacatggataaacaagtatctcttcaagtccctgcttttaattctttgggtatatacccagacttgcttttaatgagactctctacatgttaacttcttgcttttaatgagactgtctacatgacatgttagtcacatgtgatttacaacaggaggtaagagcaggctgggtgaatcataatagtgtccattaatgctgcacgtacacagaggactcctatggtgccagtgaacaaaggagcagacacctgctcccaggaccacacaaaactcaccactgcagacatagatgactacctccattctaacacataacataatttggtctcaggtacttagtgaggagagtttccatttttcctccaaagatacctagcagagaaagaatgtcatgtttgatgggagaatttttaaattagcttcagaaaccaattacatacctcaggcttaaaaaaagacagcaaaattggacaggtgcagtggctcacgcctgtaatcccagcattttgggagctgaggtaggtggatcatttgaagtcaggagtcgagaccagcctggccaacatggcaaaaccctgtctttactaaaaatacaaagattggccaggtgtggtggcgggcacctgtggtcctagctattcaggaggctgaggcaggagaatcgcttgaacctgggaggcagaggttgcagtgagccaagattgcgccactgcactccagcctgggcaacagagcaagactctatctcaaaaaaaaaaaaaatcccccaaaaaactttttcaaacccacaatctgactttaaatttcataaagaaggtgatcaacaaagattggtcttggtctattaccaaaatgatgtcaaattttccattctctttctttgttctttacatttccactccgattttatgtaaatgaaattgaacttttactagagctgtttaaacacattctattgaatacaactgtattttatattttcttttatttttatattatataaatttgtatttataaaacagcttttattaaaagtatttttgctctgaataattgtattccatacatgtaaatataaaaaattgctacatggccctttaaggcatttaataattttacaaaatacagtaacactgcagaagaaagacataagaagttttactgttaggaacattctccaagccagaaaaataggcattagagtaaggacatttccacattcaatattaattgatatttggagcagaataattcacagttagtagtcagattgatagagacaggaggtataacagtggttgccagcagctgggggcagacaataggaaaatgttgaaggggtacagagcttcacttttgcaagatgagaagttctggaggtgtatgatgttgatggctgcacagccatgtgaatgtacctactactgaactgtacactttaaaattgttaacatggtaaattttatacatgtattttaccacaattaacatttttttcttaaggttttcaaataaaaaattcggtagttatttgaataactaatgctaggcaggactggtcagcaggaaaaagctgctccaaaggtggctgagggtaaggaaagccttcgtaacccctcaggcaaatcaacaaagagatcttttactacaggaaggtgctacatctgcctcagagcagaagtggtgcagcactgatttaggttctgaatttcttaaggtctaacactgacattcttcacatgctaacagttccgatgttcaggtgcctcacagaagcaatgtcaaaagaaatatgctatctgccaagcaaagaaacaaactgagaaacagctgtgtctgcctgtgcatgcataaacttaaccaggcataaagggttcctagtgacacgtatctgcatggcagtaccacagagtactgccatgtagttgaatttgaattgtcccgtaaatgcctccaaaaagatttcatgatgatatacaactgagactgcacactactgtgtggacagaaggttgccttccatcgggctaagctccacaattaagtaaaaactgccaaatcttttgggcagatcataaaatgttcgaagtcaggacaagctggtgagactgactcacacactgtaaggactatcactgaacatttttctgtcctaagtcccagctgactttccatgacagttgtttaatttccacagatacataatgcaattatggaaaaagtgaaaatccgatatttaccaaagaagaaatgcagacatctggtagtttttaaaatgctttgaaattatgctgtcaatgctaagaggacacaaaaggtcaagaacatgagcatggaatatgaacagtattaaagctgtcaggcaaagctatcaatggccaaaagagataacagaaaacattatcctatgaatgaaaagaaagcttaagagtccagttttgtgatcttgagtaaaacaacagtatgatgtgtgggataaatgtagctgccactgggtagatattttatgaaagctttgtttattatagtatttcttttttctaaaacaatgctgcttagtggagggtaggctttataagagtaggtacatgactagtcttttgctgcagtgatttagtttgtgatgatccacgtcatttttgccacagtgtacaatagctgctgaaggccacccttgtctctcacttttcattattaaaccaaagcaaactcttctgatgaagttagaatacatttttttaagttagtcaaatgtggacactataaatctaacctctagtactatggataggcaatggaaaacatcttgaaatgttaatcctaaataaacactaagcaatgtttaatgtttaagattgatgtcattgactatgcttagctgagaagaaaacatgtgattaaccaagggaaggacttaaaggatatgtaataattctatatcaccactagacatttaaatttcacaaagaggttcaacaacttgaggaagctactgctgcctttgccacagaaccttctatctcaacaatgaaactctatctcattgccctctatctcaacaatgaaacttaggagacttctgatatgacacattgggagatcactttatgttggacactcaaaatagaaagcctgaaatggtaccaaaattgacagctctaatacacaagggaaagccctaccctgtgacactgtaatattaaagcaagcatcttttttaagataaaagtaccacacagtggaaggaaagcaatgaaacatctgcagaccctgagaacaaaagaactccaaaatcgccaacagataatcagtgcaaagtgctggagccagtataaaaatgcagagtccaatttgcaaaacaaaactactgggagtagaaaccaacttgggaagaagataggtaataggggtaaaaaaaaagaaggaaaaggatgatacaagtggcagactagagaagaggagccagatgtcaaaaagtacatggccaaaccaatcgccactttgtgaaaataacgagaatgtgtgctagagctatgaaactagaaatctatcctatatataaacagataaaattggccaggcacggtggctcatgcctgtaatcccagcactttgggaggccgaggcaggcggatcatgaggtcaggagatcgagaccatcctggctaacatggtgaaaccctgtctctactaaaaatacaaacaaattagctgggtgtggtggtgggcacctgtagtcccagctactcgggaggctgaggcagaagaatggcatgaacccgggaggccgaacttgcagtgagccaagatcacgccactgcactccagcctgggtgacagagcgagactccatctcaaaaaaaaaaacaacaacaaaaaaaaaaacggatacaattagaagatgaaaagatagaaaattttaataataaaaaataaagagatatggagcattcaagagaaagggataaagaagacaggtaaagagggctcaacatatgtataaaaggaattctgcaaagaaagaaacagaacaaccactgaaaactacatattgactcaatttttttttttttttgagatggagtctcgctctgtcacccaggctggagtgcagtggcgcaatttcggctcactacacctccgctcccaggttcaagcaattctcctgcctcagcctcccaagtagctgggattataggtgcatgccaccacacctggctaatttttttttttatttttagtagagaccgggtttcaccatattggccaggctggtctcaaactcctgacgttgtgatccacccgcctcagcctctaaaagtgctgggattacaggcgtgagccaccagacctggcccacattgattctatttttaaaaatgagtaaaagacttgaatagacatttctcaaaagaaaatataaaatggtcaacaagcatatgaaaagatgttcaacatcattcatcattagggaaatgcaaatcaaaaccacaacaaggtatcacctcaccctcatcaggatggctatcattaacaacaacaataacaaaacataataacaagtgttggagaggatgtggaaaaattcaaacccttatagactcctggtaggaataaaaaatggtgcagccactgtggaaaacaatttgtctgttcctcaaaaaattaaaattaggattgccatgagatccagcaattccacctctggatatatatcgaaaaaatggaaatcggggtccaagagagatatctgtacacccatgttcatagcagcactattcacaatagccaagaggtggaagcagcccaagtattcactgttagatgaataaataaaatgtggtatagacatacaatggaattcagcctttacaaggaaggagattctgatacatgctaaacatggatgaatcttgatgaggctaagtgaaataaggcagtcacaaaaggacaaatactgtatgattccacttctatgaggtatgtaaaataaccaaattcatagaaacagaaagtagaaggggagttatcaggggctgggttgggggtaaaagtttctcaagatgaaaaagttctgggggttagctgcacaacagtgtgaatatacttaacaatattgaactgtacacttacaatggataagatggggccgggtggctcacatctgtagtcccagtgctttgggaggccaaggtgggcagatatcttgggtccaggattcaagaccagcctggtcaatatggcaaaacaccatctctactaaaaaactacaaaaaattagccaggcattgtggtgcatgcctgtaatcctagctactcagaggctgagacacgagaattgcttaaacttgggagacagaggtgcagtgagctgagatcatgccactgcactccagcctgggcaagagagcgagattctgcctaaaaaaaaaaaaaaagttaagatggtaaactttatgttacgtgtattttaccacaatttttaaaaattgaattaagctgaatatactgaaatatactgaaaaatactgaatatactgaaaaggtacatcacatacctaagaaaaacaatccagagaagccataacaagacatattctagtaaaactattaaagaagaaaggataatgggaccacaaaatcataagagacttccagcactatttgttatgcttcaatcctttagagggaaacaactgtaccatgaagcacataagaaaagagttatatttttcatcataagaggtgcataaatgaggatttgttatattatcctctatactggtctatacacttgtaatatttgatcacacattcccacaaacgattcagggaacctactggctctgttaaattaaactaaatttgggctgaggaggtgcttgtgtaatgaactgcaacttaacttagtatgcaaactaatggaaagcctaactcaggaggatactttgggaacaaattgctgagtctcaggcaatcatagcagctgagctccagttaactgcaggcagcaggacaactgttccaatcctgttcatgtaagacgaacactgagccattaaccatcagctgtctctctacctcacttctgtttctgtacctcacttccctgctatccacaaatgcttttagaccacgttgcagccctggagttctctgaacctgtccctggttctgagggctgcctgattctagaatcacaaataaaaggcgattaaaatctgcaaaactagatttgttatacattttttttttttgagacggagtctcactctgtagcccaggctggagtgcagtggtgtgatatccactcactgcaagctctgcctcccaggttcacaccattctcctgccttagcctcccgagtagctgggactacaggcgcccaccaccacacctggctaatttttttgtatttttagtagagacggggtttcaccgtgttagctaggatggtctcaatctcctgacctcgtgatccgcccgcctcggcctcccaaagtgctgggattacaggcatgagccactgtgcccggcttcattcatcttttagcagtttccataattcaagagttcacagactagtgctgttgttggggcaaaacttgagccaggagctcaatatcacctagtcccaattcttcttcaccttctgctctgcccagttcatccctggactcctcacagaacccctcaggctctcctatgaccatgattaaatgtctatagcagtcccagcctaaatcctcataccagagtaagcaagggcattgcttctagaaactcccattcaggctcctggaactccctctctcaggctgactgaaattggctcctgaaacaatctctgtgtcaagacagtgagattcaatgattcagagtcagagtgagttggggtggagtcaatcctaagaatggaaaagggaaactgaggtgaatgaaggagaaatggattctgtgaggcacccacaacaaggacagcagagaccacagttctggtggctgtttcttaccctccagacactgtccctctgctgagctccttcaaaccctccagacatgatcagactcatctggacttactgtggggacatatctaggccccgactctgtcaaatatgtatagtgacttccatctaaaaggcacaaggttctttacagataggacaaccttgatagcactcatctgagaaagagaacaaattagaaataatcatccttcacttcctaacactcacacaaaaaaaaacaaacctaagggaaagcaagtgcatattaaaacagagttgatcaccaatgagcaagtcctaccaaagatggcagagaagctgaaaaggtcctctaggaactcactcaataaatgctcatttattccatttattgcaaagccaagaattgtaaataatttaactcacttaggaaaggatcttctccattattttatctgaatgttatctgatcttgatgttctgaagtctgacagttaccaaagcgagtaaaaatcctcatgttttccatgctaggaaaatcattaatagtttatccaaactgaaactttcttggcaactgttgcttccttgttcttgccataaattaactgtttttaaaaagctaaaatctaaagaatttccaggaccttaaaaccattagaatacaaagacactctaatttaaataaaattcataaccaaaagttaactcacctaaacacaatgtttccttgtgtcatttatcttctttgaagcccaatcaataacagattcattcattcactcacgcagcaaacatttagtaagtgctctaaatatacctgaagggacctcacacatcatctttcctgagctcttcctttacagattaggagattgaggtcaaagagagcaagtgatctgcccacagtcacacagcaaatatgagaatccatgggtgcaatcagatttcctcacctctggcctgacacgttatccaccctgccatgtttccttggctacagcaggccaatgatgcaatcggcctccagcagagaacactactgtagtaaatatcaatagctgtcaaatttatggccacacaacatggtttgaacacccttcctacaactggaagatctcccatatgagttccttctcctgaaatgtagaggcaaaagctcatccaatcctccctgcagctagagctcaggcatatggcttggctttgccaatcaggggagcagtgtgacgtagtgggcacaagcagggtaggcagcagtggcaaagcttctagtgtttgacctgcagggagctggcacttccatgctgagcgatggtcacagagctgtcttcacttgtcactgcccatcggtgagatttgggcactgatcctggctatatagaattctgtgaaactggctaaaatggactctggggtggggattgcatctaagaaccctgacctctgtgcttcattattacgtgctcaatacatatgcctggagctatatacaaaataaagggagcctctgctcaaaacttcactgtgcatcataagataccagttctcagctatctatctgagtcttaagactttttaaaaactaaatggttcttttctattaaaaaataagacaatgatgggactacttcacttttaacaatatatgctgaattatcaaatgcctatttaaaaaaaaaaaaaagatcaagaaggtggcagagcaaaccccagtattaaaatactccttcaccaaaatccaacagcaaagcaaagctggtcctcgtggctttttggaagcaagaagcaagggagaagcaagtaaacaaaaccctgaaccatttccctaacagctcccatcttaaagaataacagaagggaaagagctgaaggcagcctccagagaataagtagcattttccccaaaaccttcatgtcatctattttttccagagatggaaaaaatgctgtgactccctgctggaagaaaagcaagaaacccttccctgtggttacagatggtaaatgcttaaacgtgacaatgtcaaaggaacagtctcctaaattggacagcatggagtgggaaatggaaagacacataagggccttcctttcctctccccatcttgatgagcagtcctcaagatatggcctaaaattcataaacctagaaacagaggcggcctgagatttaaagtgaaaatgtagccaacaacaaaacaaaaaaactcgggagacagaaggggaaatgtgataattttttcatttttcatagcaagtgaacaatagatataatttaagagttgctaaatcaagaaacagaaggttatacataacaaatatacagagttatatgagtaaccactggaaaaactaaaagtagactctaaaccgtccaaagcaccagaagggaaacagtacacgcacacactcaaataacaaaaaggaaagcagggcaccagagtgtacacctgtagtcccagctattcgggaggccaaggtgggaggatcacttgagcccaggagttcaaggccagcctgggcaacataacaagaccccatctctaaaaataataataataacaaaaaacgaggaaaattggcaacagaaaaaaaccccacaaactagattataaagaattaggacttaaaacatctatgataacaatagatgcagatgagagaaattattattattattggaaaatgatatgttacacgtctacaaaacaagagaatccaatttttaaattattagaaagaattagaatagttagcaagttgactgtttgcagaattttaaagtacctttttcctataaacaagcaaaaccattgagaaaacagctgaaaagaccccactcacagtaactcctgaaaagaacggcacatctgaactagatgtgggcagaacctacatgaagaaaactggaaagttctccaatgaggcaaaaaggagaaattaaaagtagcaccatgtgcttggattggaatgtttcatactgtaaacttggccgggtgtggtggctcacgcctgtaatcccaacactttgggaggccaaggcgggcagatcgtttgaggccaggagttcaagaccagcctagccagcatggcgaaaccccgtctctactaaaaatacaaaaattagccacttatggtggcacatgcctgtaatcccagctgcttgggaggctgaggcatgaaaattgcttgaacccaggaggcagaggttgcagtgagctgagatcgcaccactgtactccagcctgggcaacagagcaagactctgtcaaaaacaaaaacaaaaacaaaaaaacctgtaaagttgttaattctccctaaatcaattcataaatttactgcaaaccaattaaaataccaggaggatttgggaacttactttggaactcagcaaaatgatactaatagtaatctgaaaaaaaatacacgagaattaccaggtgtggctgtttgtattttccacatgcttttctgcagtgtgacccttgtcttcctcccatcaagaggtagggcctatgtcccctccccttaaatgctggcaggtctgtgactgcttcagccaactgagtacagaggaaatggccccatgagacttgtgagcctaggctggaaaaagcaagcagtttccacctagtgttcttgggatactagctctgggggaagcagccatcatgtaggaagtccaactaccctgagaccacagtgctggaggagctacaagtatacacgtggctgaggccccagctgccagcaggccacaactgccagccatgtgagtgggacgtctgggatgtcccaccctgtcgagtcctcagatgagttacaaccccagctgatatccaacacaatcacatgagacctcaagcaagaatcacccagcagagccgttccaaattcctcaccaacaagattataaacaaaataaaacacctgttttaaactgctaagtttgaggataacttgtgatgttacaacagtaactggaattccatttaaaaggaaggaagggggccgtgcacggtggctcatgcctgtgatcccagcactttgggagaccgaggcgggcagatcacaaggtcaggagtttgagaccagcctgatcaacatgttgaaaccccgtctctactaaaaatacaaaagttagctgcgtgtggtggcgcgttgcctgtaatcccaggtactcaggaggctgaggcaagagaattgcttgaacccaggaggcagaaggttgcagtgagccgagatcacaccactgcactccagcctgggcgacagagcgagactccgtctcaaaaaaaaaaaaaaggaaggaaggaagtgaggaaggtaaggaaggaaggaaaggatggagggaggaagggagggagagagggaggaaaggagggaaggaaggaaagaaaggggagggaagggggaaggagagccgaaggggattggccctatcacatttaacaacataatgaatcaaaatccattcataaattcattgaacaaatattgaagatctacaggtccaccacaagctaggcattagagagacactgtgttgtgcaaaatctttgtctttatgggatttagattttagtgaaaaagaaatttcagatagtattaagtgtgctgaaggaaaataaaaatcaggataagagaaagtgctgcttaaaatagagtgctcagagaggcctcttggaggaggtggctgtggcgctgagccagggaagggcccgggtattctcacctactgctgtggggttttgcaaacggttcagcctgtccttggggcaatttgaaaaatctatttccatctaaaaggcatggacctcttgacctagaaacctcttggctaggaaattaccccatgaacattcttacacacgttagcaatacttccaagtatgttatgacaaaaatgagatacacaaaaatgtcagctcaatgggagcttattaaataaattacattatagtcattcaatagagcaccataagactttttaaaaattacatgagctatatccactgacaaacagctacatgagacactgttaggtgacaataagaaaggctggaactgtgtgcacagtatctcctcttctgactcacagagagagaaggaaccggggaagagggaaggatactcatctatgatctggaagaaatccccctttcctcggggaacacctctggggagaggagagagatttgggtttttcatttggtacctctccgtagcacctgaattttctaacaagatgctgtacaacttttacttttgtcctttcaatgcccgctagggttacctggaccatgagtcagtgtttgacagcttctccccaaagaaagaattggggctactagaccggacaaggttggttttctcttttggtactctgtatttccaaaaataactgaatggtatttttttaaataaaataatttgaaagaataaagccctataacaacaaagtattaaactgttaaaatattttcattctattgtaattataagaaagcctgcatggtcccactgcagcagccaccatgacgagcagcactctctgtaaatgcagcccttccacgctgctcagggtgacccaccccagtgagctggctatttgcatattcccagatcccccacctgcgccaggcaggcatatgctagatcagctcagaactagaaaagatgggcaccaggaagaaaggcaccaagccctccctaactcccctctgagagttgcatccttctttcctacctctttcctttttacagagcccactgtgctctgggtcccccatgacctgggggtcagagtcagacacactcctgtgcacaaatggaaccattcgttcttcaccaccacctgtgcccacacccctgtcaaagctcccccgcacccacctctgaatctcccgcatgggtaggacagcttcttcccgaagaaggggaattcctggccaggcacggtgctcacgcttgtaatcccaacactttgaaaggccaaggcaggtgggtcgcttgagcccaggagtttgagaccagtctgggcaacataacgagacctcctctctacaaaaattaaaattaaaaaattagccgggagtggtggcatgccagtagccccagctacttgggagactgaggtgggaggatcgtttgagcccatgaggttgaggctgcagtgagccgtgatcctgccactgcactccagcctgggctgtagagagagaccctgttggaaggatctctccgacagttatctcctggataactgcaatgggtcaagtgacaactttctctagctctcctaagccacagtgcagtacggtttggaaacagcaataagagtcaatcccccttttcacaaatgatcaaatgaggctcagagagattaaagaattaggcagtcattcttcacaaggaaggaagggagggagggaggaaaatttcttgtgaaattcccaaggaacagagaacatttttaaatgtttccttactcattagttaactcagtattttcatgcccaaaaaatgtcaacaaccagttttgccaagaataataaaaacagatactgactctgagcctttcttgcaagatctctcagggtacacacccggctgactcccgcacatttctgtctctcctgccttctcaaatctcgctgtctccatcagtgtctcttcttccatgcaaggctctgtcctctgaagttctctctcccctggcttcagccccatgcaggtgccccccccccgccccacatgtggattcagttccccacctgtggtccccatgattgttctactccaactccggctctcatcacccaccgccagtgtgactggggcacaatgtgactgggtgcaggatggggcagccacctcaggccccagagcgctccatcccatggccaaaggggtggatattccgccctgaaacacctgggagtgcataatgctcaaggtattccttcttcgaagctgataagtttgtctatgagcaaataatccactagttcctctgcaaggggactgcctgacttagaaagaacacagatgtaaaagattagtctttctcaaacactgccggtcatgtgtcagatatctagaacagcccctcaccagcaaacctggctggccccagccctgtctcaggcccttgtgttaatgctgggtctctggcccaggctcccctccctgcctgatgagttcccactgtgctttcaagggctctttcaggtgaagagacttagatcaataccaccttaggtgacccgaactttgactctccctcagggagcagcgacggggttttagtgtcttctctctgacagcccaaagcgcagatgccagctgctccacctcattcccagggacgagctccacagttgaggatcccagggagcagagcaggggttgagatgcaaacaattctgatcacaggcccctctctccaccctccccaaaagtgccacctgctgcatctacataattctgagagcccattcaagagaccgctgctggaaccaagaagctagttatctggatgatgtgggtccccatcggagacacgggaggggagaagtggtgggactgcttcatacccacacccacttcatgtttgccctagcaggcactgtgtagcactcatctggggccaaaaaggaataaatgacaacttgtttacagaaactgtgttgtaaaaatacctagtgggaccttgtttcaccacctggatctttagggaggtgcccgttctccccttcgagctcagcctgcccttaccaagttcctctgtttcccctcactgggaactctcaggaattgtcccccaacattattcccagaaacctgtgccaaccgctcatgcctatcttggagcatcacactatcagatacctggataactgcaatgggtaaagtgacaattttctctagctctcctaaaccacagtgcaatatggtttggaaacagcaataagtcaatcccccttttcacaaatgatcaaatgaggctcagagaggttaaggaattaggcagtcattcttcaatcattctacaaacttttcttcaacacccacctgtgccagcggatacctgcccctcataaaatactcccctccccagagatctgggggtggggtttcttgctcctggaaacaagggaaaaaggagagaaagaggtgtgagggcactcagagaggagcagcctgtcatcatgtgaacactgcccacgctgcctagcaggcctctgaagccaccccacgggagaatggctctgctgtttcccacgcctggggtctccctctcccactccagcatcctagcccaccaggtaggatgagtgatgctacatggacttccaaacatgcttaatctctgcagaccatggcacaggcccgaagctggcccgcagcacccaggctcagtacatgcccgccctcttcacgacctcccagaccagcccggccggtcacccatcttctgcacacatccctccccaacctcccctcaaacccttcacccaggtggggcttcccaggcaatctccaatctacggctgaccctgaaaaacccaggtttgaattgtataggtgcatttatacatggatttttttcagtcaaagttacaccaagtgtgccagcctctcctgactccctctgcagttgaaaatccacctcctccacctcttccttctctgccaccctgacacagcaaaactaagtcctcctcttcctcctcctcctcagcccactcagtgggaagacgacaaagatgaagatctttatgatgatccacctccacttaatgaatagtaaatacattttctcttccctatgattttcttaatgatattttctttcctccagcttactttatggtaagaatacagcatataacgcatatacaaaagatgtattaatcatctatttacatttccagtcaatatgaggctattagtagttacgttttggaggagtcaaaagttacacgtggattttcaactgcagagggagtcagtgcccctaaccgtgtactgttcaagggtcagctgtacaaaatgaggacaagacgtagtacccattccccagggtttactgctaggcttaaataagttgatatgaaacactgttagaatcgcgtctggcaaaaaaagtaagcactcattagttcttgtgatcgatccagttacagtttcacatacagatgactgtacccacccaccagcactcaccagagggggcccttggatctaaacagtgtggaagccacgcctgttcccctcacctcacacaggcctgtgtgcaaggtgactgagcccccctggatttctgactaatcatctttggaccaccagcaggtaaacaactctcccctcctgtgtccccagaatgcctcagcagcattagtttcctattgctgctgtaacaaattgccacaaacctggtgacttatagcaacacacagctatcatcctacattctggaggtcagaggtgcaaatcagtctcactgggctaaattcaaggggtcacaagcctcgatcctcctgggggctccaggagagaatctgcttccctgcctttccgggcttccagaggccacctgccttcattggctcataactctcttcctcacatcattccagtcactgcgttcatcatcccacctcctactactgactcagatcttctgtctccctctcaggaggacccctgtgattacacagggcctgcctacataatccaggatagtctccctctctcaagatccttaaccgaatcacatccgcaaagtccctttttgccatgtgagacacagattcacagcttctagggattaggatgtggacttctctgggggaccacagttccatctaccacattgacctaacccatattcaacctacccagctttgctagctcttagacgttgggttagtcccaatacctggtccacaaaactggaactgaatatgacatttcacatttgcatcataaagattctccggatgctgtgtgaaggggaaattgagaggacaagagcagaagtggagaagccacttacggggctaccagaataatctgggtaagagagacacagcaggcagaagtctgtatttttgaagaagaatcagtaggatgacaagaggctacgttaggaaggaccactggtgtctggttggaggaactgggtgaatggtggttccactccttgaaaacagagcagaagacacttatttggaggggaaatgagcaacttggttggggatatcctgaattttaagtgtctatgacttgtccaagtgcagatgtaaagtcagcaatagggtatgtcaagaggagagaggtaacagcttcaaatgcagagacctgtgtgagtgacagaagtgtccagtggggcagagagagagaagcctgggcccaggaatgtcctcctgctgaccagctgcagtgaagctccgctggccccatctctcagtgtcagccctgcccttgctgtgtccactgccagggtgtcccttgcaggggcactcactgcacagtcatcattcccagggagcatggccacttcaccttgctgctccgccacacctctgttttgggcggccctgaggatgctctgagactgggctacagtctccacaggttccagctatggatgtctgccccacagcctcatctagggaggtctgtttgcccaccattgagggccctgtggcagcacctggctcttccctctctgctatgttcaacatgtcccacagcaacatggaaattagcaaatgtctttattccacacactgtccatgggaaatttcagacccaatcttgtagaccagaggtcaacaaactatgatccctaggccaaatctggcctgctgcttttgcaaacaaagttatactggaacacagttatacccattcatttataaatggtctatggttgcctccacacaatgatggcagggttgagtagttgccacatcactaatcatcagggaaatgcaagtctaaaccacaatgagatatcatctcacacctgttacaatggctattctcacaatgacaaaagacagcaagtgttggcaaagatacggagaaaggggaacaatttctctgctggtgggaaggtaagttagtacagccattacggaaaacagcatgaaagctcctttaaaacttaaaaatagaactatcccatgtagcaattccacctttgggtatatatccaaaggaaatgaaaccagtatgaatgaagaaatatctgcacccccatgttctaaaatgaattcataaatccatacatatatacatacatacataggagagaatggaaaagctcttcctacagtagaataacaattaataaatgtagaaggaatgggccgggtgtggtggctcacgcctgtaatccccgcactttgggaggctgaggcaggccgatcacgaggtcaggagatcgagaccatcttggctaacacggtgaaaccccatctctactaaaaatacaaaagaattagccaggcatggtggcgggtgcctatagtcccagctactcgggaggctgaggcaggagaatggcgtgaacccagcaggcagagcttgcagtgagccgagactacgccactgcgctccagcctgggcaacagagcgagactccatctcaaaattataataataataataataaaataaataaataaataaatgtacaaggaacggaaatataaaattatgacttggcaatcatcgtagaggaggctggtttgggtggcaatcatcaacggatgtgaagttgaaagagagaggtttgaccagaaacaggatattggcataatctgagacttccttacacaaattataattaaaggggaaatggtgaatttaaaatgataacacctggaggacagcaataatgttaggtgatcaaggtgaatatcgccaatggtgagaagggctgacatcaacgcctcctgatgcgatgcactgagaaaagcatggcatcaactttgggattgtcctgccaagaatgcatgagccaagtctgcccatgaggataatcagatggatccaggttcagggtcatcctacagaatgcaaggcctgtgcccttcaaaactgtggaaaacgtgaaacagagaggaaggctgaggagagtgaagacacacaaggaatgctcatgttcctgggtaggaccctgggccagagaggaaaaagaaacactacttggtcaggtgatgaaattggaatggggtctacagattggataacaatgttcttccaatgttgttttcctaatttggagaggtttatgatgagtacataaagagcatccatgagtggtgagaatatacactgagttttttaggggtgaagcaacatcatgtccacagctttctcccaaaacactgagaaaaagactaatgataattgagaatttttttaccttgagaaagacaatgtgcacaagctcaagccatggggtaaatgcaataacatgtttacaattcgggaatttaagagaagagacacaggaattcttggttctgttctgtaacttttctataagttagaaattatttcaaaaaatttccagaaaacaatattaagacagagtttcattgtttattagcatagaatttggctatgagcattccagtgtactatatcttcaaatgactaggactttttacccgatgcccaagggagggttctgtctatgtgtgtgtgttgttgttggttttttttggtgtttttgttttgtatttgtttttgtttttgtttttgagataggatttctcgctgtcacccagactggagtgcagtggtgcaatcgaagctcactgtggcctcaacctcccagactcaggtgatcctcccacctcagcctcccaagtaggtggaactacagctgtgtgccaccatgcccagctaattttttgtattttcagtagaaacagggttttgccacgttgtccaggctggtcttcaactcctggctcatgtgatccacctgcgtcagcctcccaaagtgctgagattacaggtgtgagccaccacgccctgtcaagtttttctccttatctttaaaatccattattttacagggaaacatgtcaatgctgactattctacattgatttttcccagttacacaatgtaacctttcaaatcttattttaggaaggttttcttgcattatagttctaaatatttatgctattctattgctttgtttttctgtccctggacactaattatacatatattgaacctcctttgcctgtgtcctacattcctttaattcactatatcaccttcttttttttattatttttctccttttcaccctctatttttatttctgtgcttcctaagaatatctatttgctcccatgttccttctaattaagtcttcatttttgaaactcatttttccaaattcttttctgacatctctctgttctcctttcataatttcctgtcatctagccatatcttttgtagtttttacaatttctgattcaggatgggagcagtggctcgtgcctataatcccagcactttgggaggccaaggctggtggaccacctgaggtcagcagttgaagatcggcctgctaacatggcaaaaccacgtctctactaaaaatacaaaaattagctgggtgtggtggaaagcacctgtaatcccagctactcaggaggctgaggctgaggcaggagaatcgcttgaacccgggaggctgaggatgtagtgagccaagattgcttcattgcactccagcctgagcaacacagcgagactctgcctcaaaaataaaaataaataaataaataaataagtaaaataaagtttctgattcatactactcttaggaaactttattttcttttagcttatattgaaatattaatttataatttttctggtgtgctctcattttcagtagtaccattatgttcattttcatcatgttttcactgaataaatgttgcatgaggctggatcgtattccttttttgttgtccatgattaaatgaggtggattttcctgatctattaggaggaagttcccaatagatcaggaaagttcctaataaagggatggactaggatacctttcccatttggctctactgatctgtgaaagactcaaaataggaattctccaggtacccacttgtttcccagcatcaagtccagaacctttgtaaagctcagaaagatctcttgcctctagtcctttgctccagctctagaactttgaagtccttcttttccaaggctatatgctctcagcttttgatgttatctttcactgttaaagcagtttttgagatctttttccttgggggtccccttccatatctccaccatctgaacctattttctctcgccatctgtcttctgcttaacttggtgtatgtttccagtaatttctgctcaaggtgaggtgcttagaagggaggacttactgtacgtttctaagattctccaaggcctctgccaccacatcgacgctgattctcccaggtccacacacagttagttgctctcacctgttgccagaagcctgggagcccctttccagttttgccagttgctctcaggtctgcccaccagacttccatcctactttaaagggtgagcagctcatggtagtttttgggttccaccacctgtcaatagtttctttcatttcccatcactcccctgaggccactgcggctcttctccaggtccttctgatgctggtggtttggccaaacccacccagtcctgggaataaaggagtggggagagagtccccaacacttttgttgacatatcctctttgagctttatctatggctgtcttgctgattggtttagcttccaggaagagttcaggggagactgaaaaactactttgccaccatgaatacatccccataaaacatgttctgaagggcataaaacaaggaacaaagaaatgaagagacatactctgtttctgaattggaagatttaatatgataaaactgtcagtactcccaaaattgatgcactatattaaaagttttaaagttttctatctggcaagacatcaaaaattaagcaaaatgagaaaatatttgcaacacataataaagtatccatggaaattcagatccaatgaaatatctttctgcttctatgaaattaataaaaatgctcagccttgctaatatcccacgctgcaagaggacagaaaaaggggcacacactgtaggcttctgtgggtggatgtgcctacattcttttgtgaaaattaatccagaaatagctaacaaaactcccaatttgaatactcatcagctagcaattccactttggggaatctatcctcaaaaaaaaaaaaagcagtggcatctcaggctggataagcagcactgtttgtagacacatagaactggtagagattattcccagcaggagaataactgaataacttgtaataattcatactttggactactccacagccattaaagataatgtgttaaaaaataataataatgagttatggctgggaatattcgttatacattaaatttttaaaagaagttacagagtaatatgggtggtataatgtcatttttgtaaattgtttttaaaaagaaaagaaacattttccggccgggtgcggtggctcacgcctgtaatctcagcactttgggaggctgaggcaggcggatcacgaggtcaggagatagagaccatcctggctaacacggggaaaccccatctctactaaaaatacaaaattagcagggtgtggtggcgggcgcctgtagtcccagctactcgggaggctgaggcaggagaatggcatgaacccgggaggcggagtttgcagtgagccgagatcacgccactgcactccagcctgggcgatagagcaaggctctgtctcaaaaaaaaaaagaaagaaaagaaacattttccatacatatatatacaaattctaatacattttatgattgtaaagggaagcatggaaggattgcattaaacaacactggtaatgttggtggtctatgggtagagaattggggtaggcgaaagctatacattgtttgtgtgtatgtgtgtgtatatatattttttgtttgtttgtttgtttgttttctgagacagagtcttactccatcgcccaggctggagtgcagtggcgcgatctcactcactgcaagctccgcctcctgggttcacgccattctcctgcctcagcctccagagcagctggaactacaggcacctgccaccacgcccagctagttttttgtattgttttttttagtagagacaggattccaccatgttggccaggatggtctcgatctcctgacctcgtgatccacctgcctcggcctcccaaagtgatgggattacaggcgtgacccaccgcacccaacctattttttttgagatggagtttcactcttgtcccccaggctggagtgcagtggagtgatcttggctcactgcaacctccgcctcctgggctcaagcaattctcctgcctcagcctcccaagtacctgggattacaggtgcccaccatcacacctgactattttttgtatttttagtagagacagggtttcgccatgtgggccaggctggtctccaactcctgacttccagtggtccgcccgcctcagtctcccaaagtgttgggattacaggcatgagccaaccatgcccagtcacttttttatcttcagttatttttactttttatatattaatttcagagtatgaaaaaaatccagtggagttgctttttaaaggaaaaatacacacacacacacacacacacacacacacagagtcagcttccaatggctacgtctttaccaacatatgtaactggtaatgtggataactcacaatgtagctgtttgtccctgagttctgggcattaataaaatctccaagaaaaataacaaactactctattaaaggataactattcaagacctccatccagctctcttagtcttctaaactatgaacacagctcattacctctcaaaatgggcaggacatctatccacaagggaactgatccacctgctgactcactggctggcacagcccggcacaggaaaaccacctgcagggggtcctcaaacaatggaaactgcacagctctgtattcatcacagacctccggccaggcctgacacccacccctgtctccaaccttgccgagtcctcccctttcaaccttaaacttcttcaacttggtccagtggaatggctccttaaatttctcttgtatcttcacctttccaggcatgttttatgcttttcctaagaaagagagagcctccttgctaaagtggacccctttaccagcatgctttatttcatccccttctgcctaatcgttagcaggagtttggcctctaaaaagtcagagcaactaagttcaaagctacttcatagctgagtgaccttgggtaagtcactcatccctcttccccttagtttactcagcagaagcaccaagatttcttgaggctttggcttggaacagagtcaggctcagttctgctgtgttccaatggctaaggcaaatcagaggcccagtccaaactcagggagagggaaccacacaaaaccctgagcaccagcaggcagaggccaccagagtaacaggctattacacacacaataagtaagtgctcactaagcatgggctgtctgtcttagctaataattttgtttcttaaatccaggagagttgtttctacaatgggttttcaccatgtgcaaaccacagagagggcctagaaagccatatgttgctaaagagcacataggtctcattttagaagatttagagaaaccagagggcagccctaagccccacagtatggatttctttatgaagccagcccagccatcccagctgccattcttaaatgacgaacaaccttggcaaggcagttgcaccaatctcagagggcaggcatatatatggcaatgggtcagtgttccccactcacaaccatgttaacatgcaaacctgtctcaacacagcaggaaccaatcatcatttctgcaaagtgttgtagacaacagatgaaaaatggtatacactgtaccgtactgaaagaactttcaaggtgcttgcagcaaagtaagtttgaagacagaaaataagcccatgaaaaaacagacaggagggtgggagatggaggactcaggacagaagtcatcttataatctccaaaatgtaagcagagtgtgctgtgttcattgttgatccccagaccctagagtaatgtccatacataggagaactgtgtggaattgctcagaatcataggaagctagaactaacaggttataggtcgggcacagtggctcaagcttgtaatctcagtgctttgggaggctgaggcaggagcatcccttgagataaggagtttgagtttgaatccagcctgggcaacataacgagaccccatctcttaaaaaaaaaatgtttttagtattagccaggcatggtggtacacacctgtagtcctagctacttgcaaggcagaggcaggaggatcgcttcagcccagcagttccaggctgccgtgagctatgatagtgtcactgcactccagcctgggcaaaagagcgagatcctgcctcttaaggcaaaaaaaaaaaaaaaaaaaaaaaaagaataggttagagctgttgaagagaataacactgcaaaagcaaactgaattaactgttttacacatttatttaactctttaaactaaaatgtaggggatgatgtgcatttttcacataaataagcttttctactgtgtccaattaatgttttcccctttaggtttattattaaaaggcagttctctctccacacccttgggaacccaaggctaaaccaggaagggcgggctcagggaggagccaggaagtggagctaattcaccagtctgccacctgtaggctggttccagcagacttaaacctcagtgcccgctagacagacatgaaaacaatgcatattaaataatggtaaaaactgagcaatagatgtgtgaaaactatatagagaggggcatttaaatcatggctcccgtgtgcttgcctccaacctcctctcttttctttgaatactcccagctatgaccacacagtctgttgttcctattcagctctccaaggctcacccttgatctaaaatacgcttcgaaaattaatactcccattaggatgaacaaccacacctgtatcgatcgaggtgttccagaggcaattttgctcagatcttatggtaaaagccatgcaatgaacttaaaaaacaaagaccattatgaaataaacaaataagcaaagctggacgaatttttcaaattttaaaactcaagaacaaatagcaaacattagttttaaaggattggtttggatttctgtagatggaagtaaaacatactgagtttacaagcctatgcgatgtatttcagcacgatccaccaaatgcagttacagatgtcaagagttctcagaacaagtgcctctcttcataaatatctgctctgcatatatatctctcccattcccataacgtccattctttgttaatataggaaaaaaaccgactttcatcaaaatgctacaaaacgccaaaaattaactcttggggacagtcactttaatcgagacgtctttcttctatggagatttgttcaccactggcttctctgatttggtggttaagagtctgaaaatcggtcatccttaaggtctggagctcagaaagcacgccgcccccccttgcctgccccctgccccaggacgccggatgcgggtcgcctgcccagtcccgtcgcccacaaaccacgccgttctgggcggacgcgggaaaccagaagtccccgaagccaagtcagcgagcgaccacaggggccgcccggccgatccccgatatccgggctgacccaaaacccgacgggaggcgcccctcccccgcccccccaccccaccccccacccccaccgcccccggtcagggccgccgcgagggtgagaggcgcgcccacatgctgctccgctccgggttcggctcccacctcctcgcctcggccgcggccgctcggatggcgaggtcgtgtccccggcgcgcgcggtccccggcgctccctccggccgctgcgggctcggaggacggcgggcgcctggctgctgtttcctccaagaaaagtaactccgggaatcagcgcaataggagcgggaacgcgatgctccgagagcggcgagccgggccctggagttattctgctcggagtttcgaactgcgccccgcgctgcagctactcggccccggcgttggccgccggaacttgccgcccgcggtggcgtcccggcggccgcagcgcctagcccccccggcccgcgcagtccccggagcccgtccccgcctggtcgcggacactcaccgagaagcctgcccagaaggggcaggagtggcggacgcgggccgaggtggtgagcgccagcgcggcgaagctgactgccacgatgaggcatccgagcgccatctgcgtggccccgagcgccagcacgatgcgggagcggcccgggcactcgcgcaggcgggacaggctgcggggcagcgcggcgggacgcggcgctcgggggccgccggccggaggcatcgcgccgggcgcccgcacgcctcgcccgctcccgcccggcccggcgcgcgccgccgcctctcctcacagagggtccgaggcaagttgcgccgggtgcagggacggcctcccagccggctgccagggctgcggcggccgcgcgccgggagcgggccgggccgggcggggagccgggcgcccgcagcccccgccggtgcccgcgcccatgccgccgccgccgcgccgcccgcccgccggccgcgccgcgctgcgccctcccccgcccgccccgcgcgctccccggcccgagcgcgggcgcgagccgccgccgctgctgccgtaccgggcgcgagccgctgccgtccccgggcgcgagccccgccgccgtgcgctgggccccagctggggcgggagcgggagccgggacccgggagccgggagaggggcggggaaggcgcaggtgcggtcctggcgtcccagcctccgcgctcacgcctcgcgccctggcggctgcaggtctgcggaaggagagcgggggcggcagcgcatcaagggcaacggcatcagcctccgcggcggagccctgggtcggctgcgcggaggggcccgatagcggcagcgggccagccgagccttcagagcctggggacggctcgggatgggcgcgcggggcgctgaggacggggagacgggctgggagcagacaggagggaaattccgagcgctgggccgcaggtgtggcgaacaggagcctcttgaatgcaaaaatccaagatccaagatgctgcttttctgcagttcgagaatctcccaagccatccgctgagagaactcagctctggaggacattccgagaacattgccaggacacacacgatgtcccttacccacctttggtttgcatgcttttgatacaagttaaaagtttgggctttaaaaaaaaattgcacaaaacgaatttaaatgcgcaatatcattaataaccgattaaaccatctccactccctcttgccaacatagagtttaaaatatctaagtactggctcccttggaataccgggaaatcctgcaagttttgattgccataattcctttgtggccctgttgatgagccaactttaagactctgcttgtgttgaaaagggctgcattgacagattaagagatcaccagcgttagggagtctgaagggaccagacgtgaaaaggcaaagttcagagtaataaagggaaacggccggtcatttcctgagaccattcttccgtgtctttctagcagaccttactgttggatgagaaacgctagagagtgtagtcccaaaatatctcggttgctggtgcttgaaatttcaccgttagagatattgattcctttggggcttgacgatcctctattaaaatgcaaattccccttgaaggggctatagctcaagcctttatcagccaacactttagcagggatgggatttattttccaatttaacgagatggccaagggatgaacagggggtagggaattccacagatagagtgactgatctcaaaatgctggcccgtggccaaacgctgccttctcccccagttcttatctttaacaggactaagcctctggccggcattgtttaaagcactccagtacaaattccaatttcctggagacattttctgcctagaagttcgcagtgcagcactttttaagagcttgaaacaatacaaggcatgaccctggactggcaggaagttatgttcgcatttgatcatctcccccattcattcattcattcattcatccgttcattcattcctccaacaaaagttcataaagagctctctaatcataaggctttttttttttttacgttcttagggtacatcagtgaacaaaacagacaaaaatccctgcctttaagggattcagagagaaacacacaatagcctaacaaattagtgaattacagtttattgacattgtatactattcaaaaaatagtatacacccactatgtgccaggcactgaagatcgaagaatgagttgcaagccccctgtactcagagaactttcggtctagtgggaagactggcggcacactgggttcagtgttatggagactacacagtgcccccccaaccccacccccaccaaaaaaaaggaatcagatgataaggagatttgaaaagagttttctgaccacaataccaaaaatgggttgaggggtgcccaagtgaaagagtgttcagaggctgttactgtcagctggcaagaggtgatagtgttttggattaaagtggggttagtggagatgtcgagaattgggtgtgtttgggagatgtttcggaggtgtcagtgatgaattaaacagaagggggagccagttggtgacctccagtgatctcccatttatgaatgagagatgcttccaaaatatatgtgaattgatttgttttatttatttatttaagaaaggtacggaaagagagctccaagcaatacagcaggagattttggtgaaggtgggttaggagagggatctactttcgctgtaaaatttcgtttgcatccaaagggagagactgatctagaaattaaacttacttcacatttctatcaatgaaaaagcagttttgttgataaaatgaaaactttagacaaataaatttaacagagtttacttaaacaatgaacaattcatgaataaggcagccctcagaatcataagaggttcagagaactccactctgccatgtgggcagtgagtatgtatagacagaaaaagattgaagaaagtagaaatgaggaacaaaaagcagattagttgtttcaaagttactttccccataatggttaaaacggaacttccttatcatgtctgctcaaactggcctttctggatatttgtctattctctctcttctttctctctctctcttctctctctctccccccctctctctctccctctctctctctctctttctctctgtgtctgtctttcccccacccctcttcctctccttctcctgatttctcataaagtcagctaaacaaccgagtttcagcttggtggattaggactttagcatgactgactccattttaatttggtctgttggtgggagctctgtccaaatcaatggcctccaaaaatttttatttcatactatgttttacagaattttttaatcctgttgtattaaatgcaacagccaaagttaccttgatgaacacttgcaatttggagatataaatagggagataaaagtagttaaagtgagttgatttcatgggagtgaatcataaagaaagaaaggaaagaagaatgaaagggaagggaggaaaagaacagaaagaagggaaggagaaaggtagggagagagggtgctggcctgagcttagcctccctggcactgatcacgacaactcattgactctctttgatcttcagtgtttgtctcttgtaaaagcattataatcatacatgtcctagtgttacagaagattcttggagacccctggaaccaagttatggcttttattctccctggatcagatgggactaatagacaaaaccattgttcttttgggttttgtttctttgtttttgtttttttaaagacagagtctcagtctgtcatcaggctggagtgcagtggcatgatctcagctcactgcaacctccacctcctgagttcaagcgattctcgtgcctcagcctcctgagtagctgggactacaggcgcacgcccccatgcccagctcatttttgtatttttagtagagacaaggtttcaccatgttggccaggatggtctagatcgcttgactttgtgatccacccaccttggcctcccgaagtactgggaattacagatgtgagccaccacacccggccaagaccattgttcttaagcaaagcatgacaaggtggctgagcttcttgctgaaagacaggtttcagggctgcttgcaccatggggagacaaggaacacttacaaatgcctcagtcaccacatgcttgtttcagattcctgctctttttgacctgtacctgtccatacataatggatgagaaagaatctagacccttggtagcctctcttacgcagtagagagttgtgcttggatctcacaatttctgcctatggaagagtaataggggagaaactctacttctaggaatgtcagaccagctacttctcctactaaagacaacttagaaaccagggggactttttttaagtatctccttaaaagtatcaaagattatggagataatgagggaacaccaagcctagatgcaataggagaaggaatgcggagaggtgtgtgcagcacgtgggctgcctttctagctctggcagctgcacacagaatcagaaagatgaatttgagttcaggagtctccaaaggtggggacccagtaaaccagtcccctgccttgtgacagaaccccaaatggctgcatccctggagcaggaaataagtcaaacttccctctttttgcaggtgcccagaaaccccaattctgcattgcacaagcccctaggagctggcaaaacaatagaaaattctctctaaagaaagatattatcattctaggcctccaattatttctatgaatagaatttttaaaactcactttcccttaacttcctcaacacgataaaggacatttatgaaagacccaccactaacatcataatcaatggtgagagactgaaagcttcttcccaagatcaggaatttgacatgtggtgaatgtccacattcaccaccactgttcaatattttattggaagttcagccagaacaattagacaagaaaaggaaataaaggacatccaaattgtaaaggaagaagcaaaactatctctatttgcaggtgacatgatttgatatatagaaaatctcaaagaattcacaagaaagctactagaactaataaacaaattcagcaaagttaccaggtacaagatcaacacatagaagttagttgtgtttctatacaccaataatgaataatctgaaaaggaaaacaataagacaattataataatatctaaaagaatgaaatacctgggaataaatttaaccaaggaagtgaaggcttgtacactgaaaacattgctcaaataaattaaatacctaaataaatgaaaagacttgctatgttcatgcatagaaagacaatattaagatgacaacaccccaaattctctacagattcaaagcaatccctatcaaaactccaacagccctttttgcagaaatggaaaagccaatcttcaaaatcatatggaattccaagggtccccagatagccaaagggtcttgaaaaagaacaaagttgaaagactcatacttctagatttcaaaacttaccacaaaggtatagtaatctaaacagcatggtactggcataagagtagacatctagaccattggaatataattgagggtccataaataaatccatacatctaaggacaactgatctttaacaagggtgccaagttcattcaatgggagaaagaatagtctcttcaacagatggtgctgggacaactggacttgtacttacaaaagaaagaagttggactccaagctcatatcataatcaaaagttaactcaaaatggacctaaataaaagagcaaaaactatggaagtcttagaagaaaacataggcataaaccgtgaccttggctctggctgtagattcttagatatgacaagagaagtatgagcaatgaaagaaaaaataaacaaattatacttcatcaaagttaaacacttttgtacatcaaagcacattgtcaagaaagtgaaaagacaaactataacatggaaagaaatatatgcaaagcatttatcttgaccagagatatatgccatgtattcagattatggatagaactactcaaaacaaaatgacaacccaatttaaaagtgggaaaatgacttgaatagacatttctcctaagaagataaacgagtgtcctgtgaacacctgaaaagatgctcatcactcatcattggggaaatgcaaattaaaaccataatgtgatgccacttcacacccatcaggatagctatattattaacttgtttttgtttttgtttttgagacggagtctcgctctgtcacccaggctggagtgcagtggcgtgatctcggctcactgcaagctccgcctcccaggttcacaccattctcctgcctcagcctcccgagtagctgggactacaggcgcccgccaccgcacccgctaatttttttgtatttttaatggagatggggtttcaccgtgttagccaggatggtctcgatctcctgacctcatgatctgcccacctcagcctcccaaagtgctgggattacaggtgtgagccaccagacctggccagctatattatttaaaaaaaaaaagaaagaaagaaaggagcaagtgttggtcaagatatggagaaattagaacccttgtgcatttctggtgggaatgtaaaatggtgcagccactgtggaaaatggcatggtgacccctcaaaaaaatcaaacaaattctacttctggataaatacccaaatgaattgaaagcagggactcaaagaggtgtgtgtgtgtgtgtgtgtgtgtgtgtgtgtgtgtgagagagagaaagggaacacgtgtgatagggtgttactctgtcacccaggctggagtgcagtggcacaaagacggctcattgcagcctggacctcccagactcaggcaatcctctcacctcagcctctcaggtagcttggactacaggtgcgcaccaccgtgcctgactaatttttgtattttttgtagagatggggttttgccgtgttgccccagttggtctcaaactcctgagctcaagcaatccacctgtcttggcctcctgaagtgctgggattacaggcataatacccatgttcatagcatcattattccaaaggtggaagcaaaccaagtgtccatccttggatgaatggataaacaaaatgtggtctgtacatacattggaatcttattcagcctttataaggaaggaaattttgacacatgctacaacatgaacaaaccatgaacattaggctaagtgaaataaggcagtcacaaaaggataaatattgttcagatccaccttatgaagtacctagagtagtcaaattcataatgacagaaagcagggtggtagttgctaggggcagaggggtggtgggaatggggagttagtgtttggtgggtacagtttcaattgcagaagatgaagagttcctggagatggttggtggtgctacttgcacaactatgggaatgtgcttaatgccacagaattgcacacttaaatttgttaaaatggtaaattttatattatgtatattttaccacaataagaaaaaaacaatgaaattctcaaatccacgaggatggctataataaaaaaaatgaaaataacaagtgttggagaggatgtggagaaattgaaacacttgtaggttgctggaatgaacgtaaaatgctgcagccaacgtggaaaacagtctggctgttcctcaaaaataaacgtagtatttccacatgacccagtagttccactcctaggtatatacccaaaggaagtgaaagcagtgactggaaaagatatgtgtgcaccagtgtcctggagcatgtttgttcaggtgattatcattggagggctggaagcaagctggactccctggacactgatggagaatcaggcacatatagaattttgacttgtctttgttcgttaggtttaaaatgtctgtctcattgctaccaaaataattaaaggtcaactaagtgcagggagagaagaaatctaatttgacaggccttgaaatacttattacttcataggttttgtgatgagatttaagttagatcatgaatacagaaaagtattttttcaaacattacgcactttatgaatgctggccttattccgttagcagtaagttccttacggacaggaatcattcacgtttgcagtatcctaatgcacttagcacagtcctagcagatagtggtattcaattactatttattcaagctaattctgtatcttaaactatgttaaaattgaagtttttaacacttctgggatagtattgactagaattttgtgaaaaacccctgagaagtaaatgacttaattattgaaggagggtaataaggctaagaagtgagttccagttaactcaactagcactattaaatcaggttattagaaacctatgcattctaatggtttcattagaataagcagttattcatatgctcagactcaaacaaacttatacatgaaagaggtgttttgcctttagggaaaaactatgaaaattatgagtcaagcctcatgagatttgataattctcatccatcaactgaacagaaaataatggagtaaaatttatcatttggctctaaagtatgggtcaccttcaatcagaactccttcacttttattttattaagaagcaaaagtaaaacactttgcttgtggataaatggaaagttgcttagagaaataagcattaggatgcactcatttttggtgtcgattatgtgattggcccacatttttatagcaacagcaagagcagcagcagcaaattgctgagacgtaattcttatggcatatgttggcttttttcatgcaagcaagctatatgttcagtggtaacctggaccattcagcaaaatccatttctctcttcactctctccaacatgtttctctaatcctctgctccagcaaaatactggcctttggtttctttctttttttttttttttttgagatggagtctcgctctgtccctcaggctggagtgcagtggcgcgatctcagctcactgccatctccacctcctggattcaagtgattctcctgcctcagcctccagagtagctgggactacacgcacctgccaccacacccagctaattttttttttttttttttttttttttttttttttttttttttgagacggagtctcactctgtcgcccaggctggagtgcagtggcgcgatctcggctcactgcaaggtccacgttccgggttcacgccattctcctgcctcagcctcccgagtagctgggcctacagatgtccgccaccacacctggctaattttttgtatttttagtacagacagagtttcaccgtgttagccaggatggtctcaatctcctgacctcaagatccacctgtctcggcctcccaaagtgctgggattacaggtgtgagccaccgcgcccggccaattttttctatttttaggagagacagggtttttccatgttgccaaggctggtctctaaactcctgagctcaggcagtcggcccatctcagcctcccaaaatgcggggattaaaggcatgagtcaccacgcctagcctggcctttggtttctaagcttctggacagtaatgggtcactcctgctgagaatgactttcttcatcacctttgcaaattctatccctctcttaggtcttctctcacatctaaaagtcagggcagcagaatggttagggcacccatgttagtgtcacactgccttagtaaaaaccccaactccacttcctaatgaaggtaataataatacctatcttataaatttcttgtgaggattaaatgatttcatttatctagagttcttagagcagtacctggcatatagcaaacactaagtgccagttatttttctattattgtgtcagtacttctatttgaacatattcccgttaggtctagctttccctggcctatagcggcagaacagattatgctggaaaagaccaaagggaaagttaggcctacagggtctgcatccagaagatgaagttatattagaacctcaaatgcaagactgaaccaaaataggaggaaaggtgagatctaacaccattggtagactaagagcagaatacagatattcagcaaaggtggcttggtacctggcacccatcttctaagtcagcataaggcaaagaggttaggctgtttcctcaaatatggtataataactgagaagagacttcacaatgggtatttatttgaatttcccacagtgtacagaataacaccttattagaataaaagctatagtaaatatttgtatattgatgtcttaaaattaagaaagtatttaaaatgctcccccttttaagccatctattctataaatatctattgagtgaaataatatacaagacattaccctaagccatgtaaagatcagtaagacctcgcaccagacctcatatttcttatgggctaattactacctataattcaatagtcattattgtaatgactttattagttttagtcttctaattatatcattatttcaatatctttagaataaacagaccaagtaatgaaatttcagaaatgatttagtgatgtaagtgtgggatctaaacaaaaacaactttctaggaggtttcagatttgattataatcatctcctaacatggaaaggatgtagaaatcctttttctactcttttcttgtagggattaagtatcgttgattcttaagaaggatattgaaaaaaggcaataagaaatacaataacatccctatagacagtgagagcataccagaaagacataaccacaaaatagatcaactgattagatgagtgagggccacccacattatggaggggaatctacttcacttaaattccactgggttaaatttccatctcatccataaacaccttcacagaaatacccaaaataatatttggccaaatatctgggtactgtggcccagcaaagttgacacaaaattaatcaccacaatgatgaaatttttaaaaaactcctaaacaaatggagaggcatagtgtattcatgaattgcaagagtcaacatagtaaagatgtaaattctccccaaatttcctgataggtttactgcaattcctatcaaaatcccagcaagttggttttttttttaaaagacatatgtacatttatttttaaatgtatgcaaaaaggcacaggctctagaatagctaaaataatccgggaaaagaattaagtgggagtaattacttgatattaaggcttactacagagatagagtaatcaatatattgtggtgttggcagaaggatagacacacagttcaatgtaactgaatagagaacccagaaatagatccccaaaatatgctggttttttttttttttttttagatagaggcttgctctgttgcccaagctggagtgcagtggcatggtctcagctcactgcaacctctgcctcccaggttcaagagattctcatgcttcagcctcccaagtagctgggattataggcgtgcaccaccatgcccggctaatttttttgtatttttagtagagatgggtttcaccatcttggccaggctggctaattgatttctgacaaaggtgcaaaagcaattcaatacaggaagaaaataactgtttcaacaaatggtattggagcaaatggacatctgtaagcaaaaacaaataaataacaacttctatttaaacctcacactttatacaacaatgtattcaaaatgaatcatggacggacttacatgtaaaacagaaatgaaaggaaaaaagaatttcagaaataaagactaaacaaaaagcagtacaagagtgaataaacacaataaataaaaacctgaggagcaataaaaagcaaaaaggaggaaaatttttaagatcataaagaaattaaaaagataaaaaagattttagatagtggcatatttgaagagtgttaaagaagatccaacatgtggctgaaaggagtttctgaaaagggaaaccaaagcaagggaacaaaacaaatattaagaactgtctctcaagaaaataatcctgaatttattttattttattttattttattatttttttttgagatgaagtctcactgtgttgctcagcctggagtgcagtggcacaatcttggctcactgcaacctctgcctcccaggttcaagcgattctcctgcctcagcctcctgagtagctgggattacaggcaggcgccaccacgcctggctgatttttgtatttttagtagagatggggtttctccatgttggtcaggctggtctcgaactcctgacctcatgacccgccccattggcctcccaaagtgctgggattacaggcatgagccaccgtgcccagccctgaatttttaaaaagatttgaaattgcacattaaaggaggatactctgtaccagacaatatcaaaccagaatgatcatgaccaaaatatattggaataaaatttctgagctctaaagaaaaagaagatattttgggggatcacggcaaaaagaccaggtgacttaaaagggaaataaaatattggacaataattcattatgccagaaaaatgacatgaaagcattttaaggaaaatcaagtaaagaaaatattactcaaagattttatatccagtaaaactaaatttcaagtagaaaggacacagatagactgaataaagaaaatgtggtacatatacaccagggaatactatgcagccataaaaaggaacaagatcatgttctttgcagcgacatggatgaagctggaagccattatcctcagcaaactaatgcaagaacagaaaaccaaacatgcatgttcttacttacgagtgggagctgaacaatgagaacacatggacacagggagggcacaacacttactggggcatgtcaggggagagcaatgagggggagagcattagagaaaagagctaatacatgctgggcttaatacctaggtgatgggttgataggtgcagcaaaccaccatggcacacatttacctatgtaacaaacctgcacatcctacacatgtaccctggaacttaaaaactaataataataatttttttaaaaagtaaggatgcagataaactatcatcaatgtgcaaaaattcaaggaatcttgttccccataatccctttctgaagaattgtgttaatgtgcttcaaacaaccaaaataactagacagacattgacctaagtatagatggtgagcactgatatattgctccttttagaactgaaagtaaatgagggccctttcctcacaccatatacaacaattaactcaaaatccatgaaaggcctaatgtaagaactaaaactgtgaaactctttgaagaaaatataggtgtacatgtacttgaccctggattggaagtggtttcttagctatgaaacctaaatcacaagcaaccaaagaaaaaaatagataaattggacttcatcaaaattaaaacttttttcaaaagacactatcaagaaaatgaaaagacaatgcacagatagggagaaaatgtttgcaaatcatgtatcgcttaagggtctaatatcagaaaataaatgtatatatttatcctacaaatacagtaaacatgtatttgtaaactgttgcagctcaacagtaaggaaataaacaacccaattaaaaagtgggcaaaagatctgaagtgatgtttctccaacaaaggaaagaaatggccgctgaagaaaacaaaatctatatcttgaagagatatctgcacttcatcttcattgcagcattattcacaatagtcaagttatggaatcaacctaatcatccattgatggatgaaggaattttttaaatgtatgtgtgtgtgcatgtgtgtgtgtgtgtgtgtatgaaatggaatattattcagccataaaaaagaaggaagtcctgtcatttgcaacaacatatatgaacacagaagacattatgctaaatgaaataaaccaggcagagaaggacaaacagtgtatgatctcacttacatgtggaatctaaaaaagttaaactcacagaaacagagtagaatagtggctgccagggactttggggtgggggaaatggggagatgttggtcaaagggcaaaaactttcacttataagatgagtaagctctgagaatctaatgtacagcatgctgattattgttaataacactgtattttgtatttgaaatttgctaagacagatcttcagtgttcacatacacaaagaatggtaattatgtgagatgatggatgtattaatttacttaatcatggaaacaatttcataatgtatatgtatatcaagtcatcacatttcatatcttaaatatatacaattttgtcaattatacttcaataaagctggaaaaatataaacagtaaactcaaagatcgatggatagatagatagatagatagatagatagatagatgatggatagaatgatttagttgtttctccattcattgtaaagttaaagatgaatacaaattatgttgcattcctcttatatacacctaattacatcagagagctaatatgtacctcagaaaaatacatgaaaatgagtgctttataagacaacaaggattgaagctaactgggaaatccttatatacttttatacccctatatacacttaaacaggagtttcaacatcattcctaatttttcagagaagcacatccattttcaaaattattgattcactgaaatttatctctgatcattttcaaatcatattgaattgcgtgaaaccctcgaaaaaaagaaatagccaataagcacatgcagagatgcccaacatcatcagtcattagggaaatgcaaatcaaaaccatggtgagacacctcttcacacacacatgaaaagatgatcataatcaaaactatggacgagagaaagtgtgggtgaggatatggagaaagtggagcctttatacagccagtggaacataaaacggcacaaccacaggccgggcgcggtggctcacgcctgtaattccagaactttgggaggccgaggccggcagatcacgaggtcaggagatcgagaccatcctggctaatacggggaaaccccgtctctactaaaaatacaaaaaattagccgggcgcggtggcgggcgcctgtaatcccagctactcgggaggctgaggcaggagaatggcgtgaacccagaaggcggaacttgcagtgagccaagatcccgccattgcactccagcctgggcaacagagtgagactctgtctcaaaaaaaaaaaaaaaaaaaaaaaatggcacaaccactttggaaaacagtctggcaatttctcaacatgttaaactttgatttaccatatgactcagcaattccagtcataggtatatacccaagagaactgaaaatgtattttcgcacaaaaactaatatacaaatattgacagcactatgattcataatagccaaaaatggtaacaacctatatatccctcaacagatgaatgaacagacaaaatgtggtatatcccaactagacagtattttcagccacagaaagtaattaactattgatacatgctataacacagatgaattttgaaaatattatgctaagtgaaaaaagccagtcacaaaaggccacgattctattggtatgaaatgcccagaagaggcaaatccacagagagaaggaaaatagattaatggctgtcagggctggaaggaggaggaatgggaatctctactaatgggtagaggtttctttttgaggtgacaaaaaagttctaaaattggatagtggtgatggttgcagaactctgtgactatactaaaaaacaatgaattgcgtacactttaaaagagtgaattttatggtatgtgaattatatttcgtaaaggtgttatttttctaaaagaccaatggagggttaaaaagaaagtataggctggccacagaggctgacacctgtaatcccagcactttgggaggccaaggtgggcggatccctttaggtcaggagaattagctgggcgtggtggtgcacacccagctactcaggaggctgagacacgagaatcacttgaacccgggacggggaggttgcaatgagccaagattgcaccactgcactccagcctgggcaacagagcaagatactgtctcaaaaaaataaaaaagaagaaaagaaaaaagaaagaaagtatagtatgctctgattatatgctctgacaatatagatgtaatttggctatttttaaaaacgagttgaatggggaaaacatatgtaaaactgggaactacttgcagtaatcaattgattctggtagtattagtattagcatggggagatacttagcataatacaagattaagcaaatgaggtattatgggatattctatcatcccttgtgttcttgaaaaccaaattctcgaggtagaggaaaggagttggagacatacccaggctaggttacatacagaactctgtagtcctgaatttgaactagaaatgggaatatgagttcatgagataggctatctgtgtagctaaccgtgtgtgtgtgtgtgtgtgtgtgtgtgtgtgtgtgtgtgtgtgtgtgtgtgtttcgtagctctgtccactgaaaaaatctagaaacaatgaccaacccagtagcaatgaacatcccaagggccccaactatggtcctgaaatattacaccatttctcaataagagaaatggctgagctgaagtttgggatcatacaggactgcaaaagagctgtgaaagactgttatactagagcgatgacaaaagggttcaggagcccactttagatgttcttatttgctaaagattaaaacaatttttttctgagtgccaataagaatactcattgtaaggcattcaaacctaccaaatatgtttaaattcagaagtttataatcatatgttttaaaactcactggttgccctcagaggatgataggaaaacaactcattatcttaaaacctggcaaattagaaaacaattatcttgccttcctatatgaagtgtatcattgggaaaccagttagtagatgagaggaagtgtctttttttattttttgagagacagtctcgctctgtcacccaggctggagagcagtggtatgatctcagctcactgcaacctctgccgcctggttcaagcaatctgctggcctcagtctcccgagtagctgggactacaggcatgcaccaccatgcctggttaatttttgtatttttagtagaaacggggtttcaccatgttggccaggctggtctcaaattcttaatctcaagtgatctgcctgcctcagcttcctaaagtgctggaattacaggtgtgagccaccacgcccggctggaagtgtctttttgtaataatactgcaaacaataattgaaaaagatattgaattaaaatgtcatcattttgcaaatcacaattagttaaaagatacaggcactgagcatcgacagcggctaacattgaaaaaagacatgaactgaaacaagacatgaaggcctcctgatgaaagaacaagccatttatatcctgcaatggggatcaagccagactccaattcagtccagttccaggtaccaattttcaggaaactcagaagacagagtaatcatgttgaactgcaccaagagggtacacttggcaaactccagactccaaatgtcctcggcacttcagcctgtaaattgcagggaaaagaaagggatagagggtggcgggcgcctgtaatcccagctacccaggaggctgaggcaggagaatcgcttgaacctgggaggccggggttgtagtgagcagatattgtgccactgtattccagcctgggcagcagagcaagactctgtatcaaaaagaaaagaaagagagatcaagagagagagagagagagggagggagggaggaaggaaggaaggaagagaaagaaagagagagagagagagagagagaaggagaagggagggagggagggaggaaggaaggaaggaaagaaaagacagaaagacagaaggaaggaaggaaggagaaagaggaaacctgtacattaaaagagacttgatgacatagtacaaatttttaatggacaagactaaactataggccggggctgtgactcatgtctgtaatcctagcactttgggaggctgaggcaggcagatcacttgagcttagagttctgggcaacataatgaaaccctgtctctacaaaaaatacaaaaaaattagcctggcatggtgggacgcacctgtagtcccagctactcaggaggatgaagtgagaggatcacttgagccctgggaagttgcggctgccatgacccatgattgtgccgctgcactccagcctgggtgacagagcgagaccttgtctcagaaaaaaaaaaaaagaaaaaagaaaaaaaaggctaaactacagtgtctagggatagctacttgagtgataaaaccatacagaaatgaaaggaagtgattactataaatcagagagtgactactttgaaagagaaggaagaggattgtcattggggccaggcacgtggaggagattctggggcagctggcaaagtttaatttcttgaccagagagggtgattacaagcccactcacctcacaataacttatccagctccacacttgatttgggtggatttctgtgtctgttttgtctttccataaaaaggtttttaaaatctctaccagagcatgtttgtttacaatttcagattaaaacctcgccttcttggctcgtccaagttccatatgaccttcctgcaccatgacttttgttctgtatttgagagcaagtttttaaacaactcaattttgtgtctgacatcaatgaacaaagatgtagatgctgttctggaatctgcctctgcgtgtcttcattcgtcacggagaaggggctgcatatcatcttccagatggtgcttgacaagcacactctttatagaatgaaaggaaactgtggccatgaacaccgcattcagctttccctccgctacctctgcagccttttagatgctaacatagactgcctgccccgctgcggatttacagctattcggatgtcaactctattccttccagactttgtctgcgtcagattagtcaaggcaggcagctgtgatacagacagtaggaaaaacagtaggcttggaatcaagacacctggcctccactggcaactccttccagctctgtaacctgggacaggctgctcaatattcctgcatccgtttcctcatccggaaggtggggattatacacgggattgttgtgagggaggtgatgcgtgaaaaagcaacttgtgaactttgaaatgcactctcaccattcagaggtcttcagcatcctcacacagctcactcccagtgaatttctttctctatgtcattacccacagtaatgggtcacattatcatgctgccctatccaacacaaaaaatgatcagaagatcttattgtcctttgaatgcccttgcagctgggccactgaggtttgaagagatatggtgttggaatgggaagaaggcctcagggggtctcagagccatctggttccctgagtgttctcttgtgtcccttctgaggtgcctggggttccatggccaggttcagcgaccaccttagggtcaggaagtagatatcggccactctgaccctcatgcctgcctcttcagaggagctctgccttatccaatccacatcctggcgcatttgtaagtaagagttcacgtcacaggttctgaaaacaacagcagcaacaagtatgagttcaaggccaggcgcggtggctcacgcctgtaatcctagcactttgcgaggccgaggtgggcagatcacctgaggtcaggagttcgagaccagcctgaccaacatggagaaaccccgtctctactaaaaatacaaaaaattagccaggcgtggtggcaggcacctgtagtcccagctactcaggaggctgaggcaggagaattgcttgaacccaggaagcagaggttgcagtgagcagagatggcgccactgtactccagcctgggcgacagagcaagactccgtctcaaaaaaaaaaaaaaaaaaaaagaaaaagaaaaaaaaatacacttgaaggggagaaggagggaaggaagggaaattttacatgattgatataatggtatgtttaaagacacaacacaaaaggtttttaagggagccaaatattcataaacacactgataagaagcctgtgctttataaatgttctaacataacttcctgttaatatgcaaataatgccccaggggatctataatgtgattctcttcagaagtttaacaaactgctgtgtaaactagtagctattaatactttctgcattcatcttacacattaattaaaccttcaaacattgctgtcagttgttcttttgccaatcttctgtcaaacattattaaatacaatttctcatttctttctatctaaaaacatcctttttttcctgaaatatttaaaaaaacactgtaatgtaccaaaagatttgagaaaacttgtctcttctgggagatgctgtggcaaatcaattccttctaaataattaattttcttgagatcaatgcctaattagttttgcattttcttttaaagaactcactcaattttagaagattattgttaagggaaaacttatttcccgtcttcatgccctggaaggggcagtatcagaacacacagctcgggcttctcgactcctcacttgcttcttccccaaaaggagtgacttatttcatggataagcagaccccatatgtagggcagtgacccccatcctacctgctacctgttatgggttgaattatgtctcctaaaaggtacgttgaaatccaaatctccagtaactgtgaatgtgtctttattttgaaataggatctttgcagatagaatcaggttaaaatgaggtcactacagtgagccctaatccaaaatgactggtatcctcataaaaagagaaggctgggtgcggtggttcacacctgcaatcccagcactttgagagggagaccccatctctgcaaaaaataaaaaaatacagccaggcatggtggtgcacacctgtagtcccagctactcaggaggctgaggtgggaggatcatttgaaacccaggaattcaagcatcgatcacaccattgcactccagcctaggtgacagagtgagaccccatctcaaaagagaagaagaagaagaagaagaagaagaagaagaagaagaagaagaagaagaagaagaagaagaagagagaaaacacagatgtttctacaaaccaagtgtgtatcttcaagccaagcaatgccaaggatggctggcaaacacagaaactagaagaggaaggaaggattctccccaacaaatttcagagaaagcgtggccctcctgacaccttgatcttggacttctagcttccacaactgtgaagtgacaaatttctgttgttaaaccacccagtttggggtactttgttacggctgccttcacagatggatacaccatccttgctctctctgccccctggttctgctggcacccaggcatggcaagggcttcctcaagccaggtctgatctttccaacccatctctcatctgtgccaaaatcaggcaagtcatgctcatgaaattcctataggtctaggttcagggaaggagacaaggggcctgtctttgttttgtgttgctataacagaatacctgaaactgaataacttataaagaaacgtattggctcatggctctggaagctgggaagtccaagactgaggggctgacatctgatgagggccttcttaccatgtcatcctatggtggatgatgagagagtgagagaaagcaagaaggccaaattcaagctcactcccatgataaagttaatccatttgcggggggcggagccctcagggcctaattccctcttaaagttcccacctgttaacactgttgcactggggattctgtttacaacacatgcttcttgggggtgctatagtttggatgtttcacctcttcaaacctcacattgaaatttgatcctcagtgttgaagctgggttctcacgggaggtgtttgggttgtgaggatggatccctcatgaatagattaatgctgtccctggtgggggtggggaagaagtgagtgaattctcactctactttgttgctgcaaaagctggatgttcaaaagaatgggcatctcccttctctcttgcttcctctcttgttatgtgatctctgcaatctctgcacacagcagctccccttcaccttacaccatgagtggaagctccctgaggcccttaccagaagcagatgctggcaccatgcttcttgtaacagcctgcagaaccatgagccgaataataaacctcttttctttagaaattccccagcctcagatattcattacagcaacacaaatagactaagacagagggacacatttgaaccatagcaaatctctctgcagtccagatctgttacttactagcactgctctagaactttccttccgtttgttccttgtgtctatgtttctacaactatgtcatataactatatgtatagttacagcctgccgtttagctataacgtactctcccactgtgtcacttggctcacctcctgtgccagttaacaagctaatgtcagggcaaaatccactcttctattctctgctctttgtggctggtatgccctcattcattcctgatagcttctccactcaagcctgcatcaccctgagtaacttcaacatccccgtgacaactcccccaccagtgacagcctcttgactcctcctctgtatgtcccagtccactccatctcagctgccccctcccataggcatacctaggattttgtcttcaccagaagctgttctcctccaaaatagcaaatccacaaacagcccatgccctgtccatggcttccagcttgctcactcagcaatgttcaccctttgactatcatttcttcccttggctgatattcttatatttgtccttgcctcctccaatctactttatgcatcaaaaacagagaatgcttttcacattgcgtcaggtcactctgtgcatgtcaattatcaatataatgtatatagaaggggcacagactgatggttgccagggaatcataataatggctgttatggaagggtgtggtgagtgtggcttgcagtgatgtaacagtatcttgattgtggtggttacataaatctgcaaatgtggcagaattgcatagaactatatacacacaagtaagtactatgaaactgctgaaatctcaataagctctatggattgtatcaatgttaatgtctcagttttgatattgtactatagttatacaagatgttatggtgggggaaactggatgaagggtacagaggaccttcctgcacattttttttgcaacttctagtgaatctataatcgttttccaaaaaggtttaaaaaaaaaggaaataaaaatttcttcctgaccttctgctaggtggtgaggatgcagctatgagcgcaacaggctgtatctctagactcatatgactgaaacagatagggaggataagttgtggttctcatcactcttgggacaagccaggatcctgaataaggtctattagttcccctaatgggccctgccaatcctggcagcctcacctcccgctgttcttcagtaaccaccttggcttttacaagtttcctagcgtgtaggagcttcctccccgacatgcctcccaactctcacctgggagcagcctcccctgtgctcctaacctggtcaggtccctgtacaggctctgccagctccttgaacctcttctccagaggtgcaatagatctaatctcccctattaaactataagaatcgatgttttcgttgctcatgattaaatcctcagcaatgtacacggtggccagaacataggagtcactcatgaattttttgaatgagtgaatgactgaaagggctttaagcagaggataatgcaatctgatttgctttttaaaaaataaacttttgtgggggctgggcacagtagctcacgcctgtaatcccagcactttgggaggccaaggtgggcaaatcacttgaggtcaggaattcgagacaagcatgaccaatgaggtgaagccccctctctactaaaaatttaaaaattagtcactttgggaggccgaggcgggcggatcacgaggtcaggagatcgagatcatcctggctaacacggtgaaaccccgtctctactaaaaatacaaaaatcattagccgggcgtggtggcaggcacgtgtagccccagctactggggaggctgaggcaggagaatggcgtgaacccaggaggcggagcttggagtgagccgagatcacgccactgcactccagactgggcgacagagtcagactccgtctcaaaaaaaaaaaaaaaaaaaaaaaaaaaaaatttaaaattagccaggtgtgatggcacacacctgtaaacccagcggggagggaactgaggcaggagaatctcttgaacctgggaggcggaggttgcagtgagctgagttcgcgccactacgctccagcctgggcggcagagtgaaactccgtctcaaaaataaaataaaataaaataaaataagcttttgtgttttagggtagctatagaattacagaataattactgaagtagcatagagctcccaaatgttccatacccattttcccctattattattaacatcttaccttaatctggtagatttgtcacaatcaatgaaacaatactgacacattattattcactggagtccatactttgtccagaattcctgtttttctccctaatgttctttttgggatcccatccagaacacacgtccacagtataattagttgtcgcgtctcctacagctcctcgtggtgtgtcagcttctcaggcattccttatctaaagtcttatctatgcttcaccttcttaagagcagctacacagattgaagttcttctgctcgggtttgtctcttcttcactgtgtctttacttatttactggactgtttatttatataaattaatctatccttcattcacctactgaaggacattttggacatatatttatttatataaatatggtctcatggatatttatgttttgggttatagcctcctttttttggtgttcaaattgttctagctttggactttgggggctctttcagttggcctatgtgtccctttaacataaccctttctttatgggaatttattttgtgagcacttcgttattttctggcactaaaagatgctcccggcttatcctgtatatttccaacctgagtcctaggttcagcctttctcaaaaaagccctggttccttccactgaaaatggtattagaaaccaagctctgagcagtaggtatgctcattgctactggggagtcattgcttcattgcttgtaggcctgctcagttggcagaagagcaaaatatattaggtttgtgcaaaagtaattgcggttttgctgttacttttaatgtaactgtctgtatctataattctatatgtaaccatttatagatatacctctgcatatatataatgctgtgtgtaaccatctgcatctatattgagaagcatgagttcctactgaatgcttcacctctaatccattaccacatagatccttccagactcctctctttatctggaatctcccatgcctgcagtgaggagcctagcttccattatttgcttactttagttaattctttaatcccagtatacgtgtacggtggtttcagaattgttagctcatatccctagggggcacaactttatcagctagaatagagtgtgtatgtagagttcctgtgcctttagtcattcatttccaaagatacctaagccagcactttattcctcatctccttcaacaacattgttccatacatttgtggtacatttagatccttttgtcgcattctgcctctcattctgggttccccaacatcctaattatttttatttttttatttttttttagacagattcttgctctgttattcaggctggagtgcagtggtatgatctcagctcactgcaacctctgtttcctgggttcaagccattctccctgcctcagcttcccgagtagctgggattacaggcgcccgctgccatgcccagctaatttttgtattttttagtagagacaggctttcgccatgctaactaggctggtcttgaactcctgaactcaaatgatcctctcatctcagcctcccaaagtgctgggattacagatgtgagccaccgcactcggctcctaattttttttaaatttacctgattagggtttgctctctgcactgtaaagttcatagaaatcccccatagggttttgccaaatccttgtatatgccattatagtatcactcatacaaaaaaaaaaaaaaatccctgtgcttcacctattcaatcatccccccaacttctaacctcttggcaaacactgatctgtttattgtctctgtcgcttgctttttccagaatgtcatatagttggactcatacagtatattgctttttcagactagtttatttcatttagcaatatgcatttaagattcatccataactagagtcaggcgcggtggctcatgcctgtaatcccagcactttgggaggctgaggcaggtggatcagctgaggtcaggagttcgagaccagcctggccaacatggagaaaccccatctctactaaaaatacaaaattagccaggcctggtagtgaacgcctgtaatcccagctactcaggaggctgaggcaggagaatcgcttgaacccgggaggcggaggttgctgtgagccgagattgcgccattgcactctagcctgggcaacaagagcgaaactctgtctcaaaaaaaaaaaaaagattcatccataactttgttgggcttgatagctcagttctagttgctgaataatattctattgtgtgaatgtaccatagtttgttcatccattcacctattgaaggatatattggttgcttctaattttggaccattatgaatagagctgctataaacattggcatgctggtttatgtagggacatacgcttccaaatcagttcagtttcaaatcacctgagtgtgattgttgactctgatagtaagactatgtttaggctgggcacagtggctcatgtctgtaatcccagcattttgggaggccgaggagtgtggattgcttgagcccaggagttcaagaccagcctgggcaacatgatgaaaccctgtgtttccaaaatatacaaagattagccaggcctcatggcatgcaccgtgtagtcccagatactaaggaggctgaggatgggggatctcttgagcctgggaggcagaggttgcagtgaggtaagatcacaccacgcactctagccggggcaacagagtgagacccctgtctcaaaaaaaaaagaaaaagactaggtttagttttgtaagaaagcgcaaattctcttccaaagtggctgtaccatttttgcattcccaccaataaatgaacattcctgttgctccacatcccctccagcagttggtattgttggtttttggatgtccgccattctagtagatgtgtgggggtatgtcattattgtggtgatttgcaattctctagtaacaaattatgtttaactacagattaagtattctaaaatcatcattttgggccaatgcccattatttaactggcttaacagtaataataatattgattcagaaattttatttagtcagttatttaagagaacattttgcagctagttttgcttgaggtgttcatcaggtcatgacatggtttaaagctatttcatcattgcactgatgagatattttatcattgcactggtaagatattttatcactaagattatatctgttttaaaattttcaaactaaaactactaaatgtatggtaacaaattttgaggcttccattcatccattgttgaagtgacctaaaatcttttttttctttctttctttttttctttttttgagacggagtctcgctttgtcgcccaggctggagtgcagtggcgtgatcttggctcactgcaagcttcacctctcaggttcacgctgttctcctgcctcagcctccggagtagctgggactacaggcgcccgccaccgcgcccagctaattttttgtatttttagtagagacggggtttcaccgtgttagccaggatggtctcggtctcctgacctcgtgatccgcccgcctcggcctcccaaagtgctgggattacaggcatgagccacggcgcctggccaaagtgacctaaaatcttgacccagtccaagggtacttcctcatcccatctccatgcagggaatgttcatccttttagaacatgttgatagcaagtccatcatttttaagaggatttttaaaccatattctcagctctactggatgttaaatcatgtgactatgaacttaataggcaacgtgcatcacaggacatgtcagggaagataggttcaaatgtattgctgctgagcatgcacagaaagcttaagtaagagaaataataatgatgcaggattacttgaaggctgtattgaccatctattcatttagactaataaggatggagatagattcaaattgatcacaatggtgatgctctaaagagacagaccatgaggttctgcttcccagttccctagaactcccttggtccaggaccttctgagggctggtggttgaggttttcatttgattctcacagttgatagagcaaactttaagaagctgatatagaggagaaaaaggatcaagttaggcatcaggttcctgggtccactacctaacaccagtgcttccttggacaagttacttaagctccataagcctatttcctcatgtggaaactggtcataacaatcgcattataatccctactttgtccaaattagatgaacactgtgtgtaagacagcaccattgtcttacaaagcagttacaaactggcagccagatcaggcacaggggcaggccatttaccctgcaagatgatatatgttttaaaagtttgagtcaactttttcaagttcaaaaacttcatattaagccaagatttatggcttcctttaaaaactttaatggatctcacaatacagtccctacatttccaagagccgagcagcagccctgccctttaggcaaagcaccagctctccaggtgcctcagctccctaccttcctagctgtctctatgttttttttattaaaaccacaaataaactgtaaagccataaaataagtgattaatattattgctggagataacttacggaaggcttcttaacacctgagaggcgatgtttcactcagagtaaaggtgagggtagcctctatacggctggtgacagaaggtgcccatggcacaattcagtttgttgagccaaattttctgtgcttcattccacagtctttgtaatctgagcatgcatggcttgagaaacactttttaggcacacactttgatataaaacaatttgtcaaaaaaaaaagatgctggaaattccagagtcaagtagtctgccttactgacatcattcatggcaataatattatatgggctgctatgagcatctgctcaatattatatgggctgctaggggcatctgcccactttcctagaatgccacttttctttcactgggtctatccaaattggaaactccaaagcccatcccagttctctcccaccatcatcatcatcatcatcatcatcatcatcaatcatcatcatcgtcatctcatcatcatagatgtgatgatgatgatctctctctcccttgacctcttagggaaattactatctataaaaattaactggcaatgagtcacatgttgctttgaaacctgttctatcatatcatgatgtcttattgtatgacctataatttatttgattcttttgtagggacagggtcttgctatattgccggggccagtctcaaactcctggcctcaagtgatcctcccacctcagcctttcaagtagctgagactacaggcatgagccaccacacccagcttatgacttaattattcatatacaggtagtattcactttgcatggtactgtggaactgtaaaaatcaccatgcaatctgaaaccacgcaaagaaatattaataatcaatggggaaaatatgatttttctttctttttttttttttgagacagagtctcgctcttttgcccaggctggagtgcagtggcgcgatctctgctcactgcaagctccgcctcccgggttcacgccattctcctgcctcagcctcccaagtagctgggattacaggtgcccgccaccacgcccggctaattttttgtattttcagtagagacggggtttcaccgtgttagccaggatggtctcgatctcctgacctcgtgatccgcctgcctcggcctcccaaagtgctgggattacaggcgtgagccaccgcgcccggcctgatttttcaatgatacgttctaatgcttgtaaaaacattaaaatctctcttactggcagttataaacaataggaaaatgaaaaggaacagtaaaactgatatttgattatgccttggtgaattggcatactcctttctaagtttgcatcacttccaacattttcccctttgtgctttcaatgtcataaaatatatctgagagttccattaacttaaagtgtttccccaccaccaccttttttttttttttctagagttacttcctctggggtatcttcttcattctttttgtcatgaccttttccctcatttatgtctgtaagtttattgtcaataagtccttctggctgtatatctagagtttctccgaaggtggcagggtcaacattcacatgatcagctatgtcttccataactccacatggtcagctatttcttctataactccatttacatcccattcaaatttcacttccatctttaacactttttgtttcttttgtgtactttcatctttgttggccaatttgaccttctaattatctgtttttataaaatgccacctgggtttatcactgagaatcaccgaggcagcacaactacacactttgctggcagtgcaattgaatgacatatgcacaatgaccaatcactgcagattttgaaagaacttgctgcgattggtcaccaagcactgcaggtgttggaataaaggtcatgattggtaactgactgtggtgcgcatctgttacttacatagtgatttgtggactgaagagctagcagccccatttgtgctccatgcaatgactcacagttaatatgccatggtaactgtaatttgaaccgtgttgttggaagactgagttatttaatgaaaccatggtaaatgagttcgtttcatgcttaatcagaaccacgagaagcaaagcctgcctgtatttgtattctgtcttcacaagtccagtgtaagccccatgagggcaggacccatgactcaagaagtcatctgcacatattccccatgctcaccccaagcacctactacagtaccttgtgtatgaaaaaatactcgataaatatttactgaattttattttcttcaccagagaaagaactgtgtagatgtaacacagtattgaaagtcaagagacttcaattcttggtctgggtctggaactaattgagtatgatttttcagacactctctcttttaaaaaaatgtattttaagcaaaatctctacctatggtaaggatataatcagaattctaacaactattgtgtcttagtcatattcaagatgaaaaaactgttttagtttattattttattatttatattattttattattttttgagatggagtcttgctttgttgcccagtctggagtgcagtggcgcgatctcagctcattgcaacctccacctcctggattcatgcaattctcatgcctcagcctcctgagtagctgggattacaggcatgcaccaacatgcccggctaatttttgtatttttattagagatatattccctctttcagtgttcctgggagctccttaatgagccaaaacacaaagccattctgacagagaatgctggctgtcagctgcattcattcagagctaagtgatctgatccacacaccagcctaacagccaaagtgatctcactaaaatgaccaatatcactgcaaaggaaggttttccaggccaagagaacgtgcatgtgcaaagaccctggggcaagaaagaacctggcatttcgtagctaccaaaagcccatatgcaggagagcacagagggcagaaagatgtgaagagaatcacgagatggcccaatgacgaaaggggaagagctggaagggagtgccatgagcccctgttgaaatccctctggctgcagtgtggtgagtggatggcagaagagtcacaaaggatgtgggggaagaagctgtgaaaggatgccagaagagatgtgatgtgacctggccctgggtggaagcaagggagatgggaacaaaggcatagcttccagagaggtcaagatgtcaaaccagtgtttgaggcaggtggtccatgtgtggtcccagaacagcagcatcagcagcatctgcagggaacttgttagaacacgaattctcaggcccactgtagacttcctgaatcagaagctctgagatttctgaacagttggggttttctcaagccctctggaggagtctgcctcttgctcaagtgtgaggtccaccagacgaggtgatagaaacagaaaagaacctgcaaagatgactcctgagcaagggggctctcccacagggcctgggtgtcagtgagtgctcttcgggggcaagagagaaccctgggaagcactgagaagcagacagcaaagcccctccaaaaaatggtgtgaaactccaatttcattttatttaattaattaatttatttatttatttgagacagagcctcgctctgtcatccaggccagagtgcaatggcatgatcttggctcactgcaacctccgccgcccgggttcaagcgattctcctgcctcagcctcccgagtagctgggattataggcaagcaccaccacgcctggctaactttcgtatttttaggagagatggggtttcactatgttggccaggctggtcttgaactcgtgacctcaggtgatccgcctgccttggcctcccaaagtactccgattataggcatgagccaacatgcctggcctgaaactccaattttaatttgaaggacacatttgacaacatatgaattaaatatatctatatggtagatttctcaccaagaatttagatgaaaaaaagagggaaaggagacagttgcaacatttatgacgagggaaacggtcactatccctaatatgcaaaggagtccatgaggaaactcgatagaaaactggataaagaaagtgagtgggaatttcacaaaacgaagaaataccgataatgaataaaaagatcatcagtctacttagtaaccaaggcaatgcaaattaaagtggcaatgacatttctgcctatcagatggccacaagaattttttagaccaaataacatccagtggatcatattccacattgtggtcgagaatagaaattggtacaatcttcggtgatggtaatttgatggagtcttttaaaacttaaaaatgctcattctctgaaaatgagcagaaaaaaagaatttgtatgacaataatttttgaaagtgataaaataaactgttaagacagtttaatttctacgtagataccatcttattcataacatattataccaagtaattctcaatttactttcaaggtaattataaatccctgaagtcattatacatctcacccaaggaattataatatctagcaataacaaaaatacattgaaaaggagtaaactgctcagcagattttgaatattttattttgaaattcaacgtggaacttaaccaaaatattgttttatttctcttggcaaagtatctcaacagagagctatttccctaggaaaaaaagaaaatcttttattccctatgaaatcaagtccactctaaggaagctgattaggaaggagaactgagtgcctcaagctcagtagtgctgtcccgtgaagatgatgtgacttggcccccaaagggtggaagagcccttaccggcatcacgagtaagggcaggtgagaaaggtgggcacctgcaggtggtgctctggggtctacacacagtgacatgcacaggtgacacaaaccgtggtatttataggagtattcaaaggcaggctaacctcaaacactctcagcttagaaatgtacagatagataacgtttaaactgagacaaagctttgcagtttatgtgaagctcaaatgctgctgaagctgctctgtttcctggcccacccatccaccagcctgtgtatcctccccaatgaacaaatgatggaccaaaatgtggtatggcaaatggcaaatgtaaaactggagcaaagagattgtcaggctctttgagaatattactttttctaaaatatagttgattgattattcttttgagagataatcataggcccagtggaagttcaaaggtatatatcgaaagtcaattggcctcccaccctctgaacttgctttgaattccttgtgtgtcctcccaggacagtctatgcatacacaaatacctcctctatgtgtaaatgtcagtggcatgctattcacactcttctgagtttgtcttatttcacttaaccatatactttggaaattgatccacatctgtatctctaaatctgactcattttttaaaagtcattttattttaaataaaatgtggattcagggcagggcatggtagcacatgcctgtaatcccagcactttgggagaccaaggcaggcagatcacctgaggtcaggagttcaagaccagcctggccaacatggtgaaaccctgtctctacaaaaatacaaaaactagctgggcatgatgggggggtgcctataatcccagctactcgggaggctgaggtaggagaattgcttgaacctgggaggcagaggttgcagtgagccgagagcaccattgcactccagcttgggtgacagagtgagacaccatatcaaaagaaaaaaataaaatatggattcagaaaactgcaaaataaaatatatggcttaatgaattatttgaaggtaaatactacctaggataagaaatagaactttgccagccaccccagaagcacctccatattccctacctaatccctgtcttctccctcccaccataagtgacattaatctgacttgttttcatttttatttttatagctttatcacccaaatttgctcccctagaccttatactttagtcctacctattctaaaaaatgtgtgctaggtcttttaagtctcttttaatctatatggttcctcctccatccatttcatttctttacaacttatcgttgacaaatctgggctagtcgaatttcccatgtctgtctttttcttttcttttccttctttttttttttttttagatggggtctcactctgtcacccagactggagtgcagtggctcaatctcggctcactgcaacctccacctcctgggttcaagtgattatcctgcctcagcctccagagtaggtgggactacaagcgcgcgccaccacacctggctaattttctgtatttttagtagagacggggtttcaccatgttagccaggatggtcttgatctcctgaccttgtgatccacccgcctcagcctcccaaattgcatgttggtagcaatttgctatgccctttacacttaagggtcagtttttctgggtataacatttttggcttatactgtctttccttgagtatgttaaatatgctaatccattctcctttggtataaagcatttttctcaaaaaatcctggtaatagtctatttttcttttccttataagtcacataagactttttcaagatgtccaaagaatttctctagaggttcaaatgattttttttttcttaagtactaataatttcagtaggatatatcttgacagcagtcatcctgggccgatattctcaagtgtgcattgaaccttttctttctttctttctttcttttttgagacaggttcttgctctgtcacccaggctggagtgagtacagtggtacaacctcagctaactgcaacctctgcctcccgggttcaagcaattctagtgccccagcttcctgagtagctgggattacaggtgcaagccaccacacccagctaatttttgtattattatagaaatgagatttcaccatgttggccaggctgttctcgaattcctggcctcaagtgatctgctcacctcagcctcccaaagtgctgagattacaggcatgagccaccgcattcacatttcaatatacattatcaaatcttttatttcaaggaagttttcttggattatagctcttagtacttcctctgttctcttgctttggttttcttcatgaggaaaacctattattcatatgtacaatagccttcaatgttcactactttctcttaaatccttctctcttcatttctttttttttttttttgtcttatttcaccttttatgtctctcgaggcattacccttgtatttgtttacttttgtgttccttccaggaacacaggtattgacatccatcaaatgtatttaaatccatggattcataataattagtctaccttacagaataattatttttagttctacttttttcctgagttgtcacttcatttccaagtttctctaattctgattgatgctgttctgccatgtctatcatgtacttaatgtctttttctgaaatagatcaaacagaagcttgctgttttatgactatgtctctctgccatgacttgtcagttacagtgttaccctattctttattctctctagtttttaaaattactttgcataggattgaacttgatactcttctagtgctcgttttttcatgtgaaatcaagttttcctaaacttttagaacaagtcagggttccctagggggacagaactaatagaatagagggatagatagatagatagatagatagatagacagacagacagacagatagatagatatagatagatagacagagaaaggggagtttattaagtattaaattatatggtcacaaggtcccacaataggccgtctgcaagcctgaggaacaaggagagccggtccgagtcccaaaactgaagaacttggagtctgatgtttgagggcaggaagcatccagcatggaagaaagatgtaggctgggagactaggccagtcttgccttttcacgtttttctgcctgctttatatttgctggcagctgattagattgtgcccaccagattaagggtgggtctacctctccaagcccactgactcaaatgttaatctcctttggcaacacctcacagacacacccaggatcaatactttgcatccttcaatccaatcaagttgacactcagtactaatcatcacaaaggccatgttaaggaatgcttttcaaacttcacagggctcctacttctgtgttcaaaaatagagccacctgctttcagggatttgctggctgtttctttcccccaatgcagatggaaactgctccttcctttctttcatccttgtcttgctcaattttgattcctctcccagcgctttctcctgagtgtggagcccttcctgatcagtcttgggaattcctaggggctcgactgctcctgcctcctcctgcctcctcctgccttctttattattattattattattattattatttatttattattattattttttgagacagagtctcgctctgttacccaggctggagtgcagtggcgccatctcggctcactgcaagctccgcctcccaggttcgcctcccaggttcgcccattctcctgactcagcctcccgagtagctgggactacaggcacctgccaccacacctggctaatttttttgtatttttagtagagacagggtttcaccctgttagccaggatggtctcgatctcctgacctcgtgatgcgcccgcctcggcctcctaaagtgctgggattacaggcttgagccaccgtgcctggcctcctcctgccttcttactgtgggcacctgaactacctcgcactagagaggcaactcttcagctccacctgctcgtctcgaattggcccacaatactttctagtgaatactggtatatctggggttcttctgttctcaggtctatcatgcctcacccccttgctttctaacttctttcagcccctcaaacccagataccatgcaactcttgaggctgttggccatttatatatgctaggttagtgggaataatttgtcacctagttttgtcataaatattttccttgggttgtgggttttgctgcctagtttctgtgtgtctgcatggggacttggaaaaactgaaaacttggacccctttgcctagaatctggtttattctttataacaggggcactgtatttatctaaccagtcccctattgatggatatgtgggttgtttctgaattttgctatcacaatcaatgtgccctattattgtttgaatgtttgccccctcccaaactcatgttgaaatttaattaccattgtaacagtattaagaggtgggacctctaagaggtgattaggccatgagggctctgccctcatgaatggattaatactgttattgtgggagtggattcacccccgttcatctctctctcacctctctttgcccttctgccatgttatgactgatcaagaaggccctcaccccatacacagttcccagaactgtgcaccagtcatctgtttattatagattgcccaatctataatattaattattattgttacccaattattactaattaatactcaatctataataataataatctgtttattatatattacccaatctgtgatattcagtcattgcagcacaaaatggaccaagtcataccctttacacaagtgcatatgagcaggtacatctgtaggatacatttctagaggtggaatagttcaataaggatatgaacacagtaggtgctcaaaaatatttgctaatttgagttagaaaatgtatttgccacaatagtaataaaatttgttctggcccacagcccaggtagacttctattgagaacaatgtacttaaatactgttaagcacaactttggggctccttgagcagaagaaagaggaaacaaaaaaagacactgattcattcctgcagttagcaatcaggtgttgcctagtgtactacagactctactggggcctggggatatagcagaggtcctagccctgttggagctcacagttcagagtggagatgcctttgttgtttgagcaactttgagaattaaatgattgctcttcatactcacaattgagtaacacttcgtaaaacgtaccatccaatctttgtctacacctagaaaaacttcagggtaaatttcagtgcagagcacagggagaacagctgtccaggataaatacttagatgtcagctgtccatttggtcatatgccatttctgagagtcagtctacaacctcctcttcagaaggcacccaaggttttctgtaaacagatgaggctgcttcaggggtacactgcgatgcttcattcctgttggtactggagtacaaatctgggaactttaaaatgcatcgatggtggaaaaaaagaaaaaaacaaaacaaaaacaaatagcaaaagcggtgtgcattgcttcagtttcagccaagttcattctctcttccagaaacccagcttccatgctgatgtccttaagccatcaatgccgtcaacaatgctgttattccctaagttcagggtcaataaaggcagagctagctccgcagctcatggcaaagatctccatttggccataacattttcccagattgacctcgtaatgtttttcaacacggtgctctggacaacctctacaaagaggtgaaggcatccaagctgagtctcatctcccatcccctatgtgactattctgcactgaaacctgggactcttcctccttctttatccctctgcagtgattcagtccccaagtccaagtctattccaatgatcccttcacctctatatttcttctactctttctgatcatcctccataagttctgctgccagattaacctgtcacccctttgaagccatgattcatgtgggctggtctcaggctgatgtgatgttcaaagaaacgcagtctagcatccacttgtattttcaaaaattgctcccgtcctttatgtctctttagtcccatgcaggagatactttgcctatagaaacatttctcaaacaccctctttgtctgtctcctactcccatcacttcctggggcttcttctgtgctttcttgtctaaactcccccagtccctagccccggactctgagacacttctcactccacccttcccccttccctggtctttgcatcacaaaagcccaaagagtcagcagggaaatgacccagcctttcttagagagcttggggaaagaaacctggtggggaaactcttttagtcggacagacagaggcatattaaaactcattaaaaaaaaaactcttaaaaaagaaaaacactttgtaaatgtaattttttctgctccttgacacagattttcccatcatcccctagcgtctaatggatagagtccacgctcctggcctgggagtcaagaccctccacgtgcacccttaacttatgtctcaagcttctctactgcttcccagccttacccctctgcccttcccagccactttatctgctgtccctgaccacaccaccaatatcccagcatgctggctcctctcttcttccccatccaattcccgattttccttccagtgtcatctcaagtggctttatctcggggtttgatgttttctgctcctcccaaacctcccaagccttctgactcttcataagagtttgttcggtgaatgaatgaagccctcacttcatgcccttctctggtacaggaatcgcatcattcaggaagcttctttgagcaactaacaggcattttcttagcttatttcgttgcctttaaaccaaggctgccatttctgcctgtgcgttctgtctgccttcgctgcacctccactccttcaagcttggattgatgacttctgttctctaattttatctgggcaatcaaattcccaaaatatgtgtaaaagagaagattgcattcctattttacaaacgtggcaactctgtggaatttttaatcagataccagcttttctgcatctctgtgatgtttttcctccttcggagtcagtagatagggccttttgctttgcattgttgaccattgtccttgccttctgacattttttgctgtcttcctcacgtgcattccacagtcagaatactgggctttgtccttccctctttcattacaagaagctctgctataaggatgttttgtgggttcctcagctctaatgaaattccaggcatttccttgaagctggcccccagggagaagctactctcactggtctgtgacgctcagctagagaggagatgacggcgtgagtttggttctgggctggaatttcttgttgcaacatcccagcgtggcccctcttagaaccttcccaccaccacattcaaatcttattcctccagcctctggcacaccttcagcctgctaccagcagagaaaaaaaaaaaaaagacatatgttcttgctccatatatccttgaggtgggcaaaaaaattaaatgttaaccatggaggaaattgtgcacatccagacaggacactgtggcagtcagatcagtgccaaattctgggaagttatcagtgatggtcatagcatggacctaccagtacctgcccagggaccacgatctgtagctggaccacatcttggtgtgccacagtgaaggcactggggacaaatatgttcctcccactatcctggtggatccagaacctgggatcatggactctgctcagatccttttgaaaccatgccccaaagagttaaagaaaccagtgactcacagaaattcttaagcctgcaggatggcagataagaaaagaaacagcttgctgaaattccctccaactataaggtaacaaaacaggctgaaatcagttgaaaccaatacggcccactggagtatacgcagaacgagactggtgatgctacgacctgaatttcctctgcatgtttcatcctaactcccccagaatttgcacgtgggccccataaaaaggcaggaagagataattgtccatgcccaaggactttgcagaccacccttttcactccctgaaccttttctaacaaaagtacagccttatgcccagcacagggagaccgatttgagctagaatgctatctccttgttgatagacctgcaataaaaagcgtttcttttctgaaaaacccagtgtcatagcgttggcttctagcgcatcgggtagtgagcacttttgcttagatctgcagaccagaccactttgttttcggtcagtttggggcaggcagcagtacacagtggagctgagctggttgattcattcctggatatgtgcagaaggaagctgagagctgtgactgccttcagggcttccagctgacccactcactgggtgagggcacaggctctggaatgggcaccctcctccacagcaagatccgagaagaggatcctgaccacatcatgaacacctccagtgtaatgccctcactcaaagtgtttggcactgtggctgagccctgcagtgccccctccccatccatccactggtagagaacactgatgagacctgcggcacagacattgaggctccttataatattcgcttccgcaccctcgagctgaccacacaaaactatgaggacctgacccacctgtctcagctaacatgcgtggggtcaccaccttcctctgcttccctcaccagctcaattcggacctctgcaagctagcagtcaatacagtgtccttcccacgcctccagttcttcatggctacctttgcccctctcaccagttgtggaagccagctgtatagggctctcaccatgcccaaactcacccagcaggtctttgatgccaagaacatgatggctgccccaccaggactgccttcttccatgaatatccatccattcatgaaggaagtcaatgagcagatgctcagtgtgcagaacaagagtcgccagcagctatttcatggaatggatgctaacaacggtcaagacagccatgtgggacatccttcctcatggccacaagatggcggtcacgttcgtcggcaacagcgcggccacccagaagctctccatggcctctcagggcagttccctgctgtattgtgcgggaaggctgtcctccactggtatgcaggggagggcatgaacgagatggagttcgctgaggccgagaacaacatgaatgacttcatctctgaacatcgacagtctaggacgccgccgcagaagagggagaggactcagtgaggaagcccagtgggaggcctaaggcagagctcccatcacctctggcatctcaattccttcagccttcttccttggctgcccctttcttctccctcagtagtcgtgtttgctgcctttaccttgtttatctggggagagggagggtctagagcagtgcctggtacatagtaagtgctcaataaatatttgtctgctgaatgtctcctctctctttccactccaggaaacctagatttctgccgatctgggtaaccgtgtatttccttctggtaccctcctcccatctgcccaattaatatgtccctctgttttcaaaataattctccaggaagctgggtcccattcagatcccatttagaaccaaccgggtgctgaaaacccagataatgtgcaccatcctatgtccacgtagtagccagcactgggaaggtagaaggtggcaggaagaagttactgcaaggggctgggcatggtggctcacgccagtcatcccagcactttgagaggctgaggctggaagattgcttgagcttagatgtttgaaaccagcctgggcaacatagcaagaccacgtctctattttttttttaagtaacaataaaaaaaaagaaagaagttactgcaaggaagaggatgggattttccattctagaacggttttggagagggaaatccaggctcataaagccataattcccaggtatttctgtgctccaattctcaggttcaggggaggtggtaacagcattatcccattttcagtttcctttggaggagtcgccccgcttcaccaagagaggtctttccttctcccaccactcctcttctctcacaaatttttttttcttttttttttttttgagacggagtctccctccattgcccaggctggagtgtaatggtgcgatctcagctcactgcaacctctgccttccgggttcaagcgattctgctgcctcagcttcctgagtagctgggatcacaggcacacaccaccatgctgggctaattcttgtatttttaatggagctgggttttcaccatgttggccagtctggtctcgaactcctgacctcaggtgatccgcccacctctgcctcccaaagtgctgggattagacgtgagccacaacgcctggccccctctcacattttggatcccttccttttccctaatcagaaaaggagattaagagggagagatctgcctgggtcccttagcctctagaaatgccctctccattcccaatttgtcttaccccttaaaaggtgtaacatccctgacatatgtgggaaggtgtgttcccccacctaaatgtttgagtcattcccaagatgagaggggatggggcaacatctcatctcttccttttgctattcccttttttcccctgctcttggttttgtcctaccctacacttcagatttctattttgggttgaacttgctgctttttcctcataatgaaaagatgacattgtcccaagagccaaaattaaatgggaattggaaaaaaatccactgtgcagattgtctttcttccctacccggcagggatgatacagggaagcagcgtccaataccacctttgttaagagcctagaagctcaaagtgtgggcactcctgagagagggccctcatgcacatgccatggcaccagaggacctggtgggacagcagcccccaccccggttcacagagcagctgccatcgcccaggctaacctggagcatgcaggtaacagtgtctgttggaggatcacacatatgttgttgctagacaatgtaccctgaacaatgcaaatatacagcagttttgcaaacatcagagcagacaaaagtcattcttgatgtattaccctcaatttggaataaatcctttgtgcaacagagcatttcccttaccctttataaaaagctccttttaaggcagacctttggacaaaccaaggggacgatgaccccttggtcagacttctttttaccaggatgtggcagagttagcctgcagtgtgagaagacaagtcctctgacaccacttgaaggggctgagacagacccggtcagggctgatggctgtcagagggctcaccactccacactcagaggtggatttttttccaattcccctgctctgtgagacagtcacactcacagagtgtctctttagaagcttttatggaagcttttaaatttgcttcacaaaatgttaacctggctgtgttttctgcattgcatatatttaaggtgtatgacttgatgatctgattggttgaatttttgattgtttaccttttccttttttcatactgctttaagtataacaaaaagggaaaggaaacttttaaaatacattggatctcatttcccctttacagacaagtattttgcttcctatgactcaacttttatattagtcaggattctccagagaaacacactcaataggctatacagagataaataagaggaaatttaggggctgggcatggtgcctcacacctgtaaacccagcactttgggaggctgaggcaggcagatcacttgaggtcaggagtttcagaccagcctggcccatctctactaaaaatacaaaaattagccaggtgtggtggcacatgcctgtaatctcagctactccggaggctgaggcaagagaatcacttgaacctgggaggcggaggttgcagtgagccgagatcatgccactgcactccagtctgggcaactgagtgagacgccctctcaaattataataaaaataaataaataaataagataagatttattataggaactggctcatgtgattatggaggctgggaagtcccacggcaggctgtctgcaggctggaggcccgggaaagccaggggtgtactgcagcctgagcccaaaggccagagaacctggggagcttatggtgtaagtcctggagtccaaaggcctgagcaccaggaatgcacacgtccaagggctggagaaaatgcaggtcccagatccagaaaagagagagagagaattccctttgcctcctccttttttgttttgtctggcttctcagtggatgggatatgcccacccacattggtgagggtgatctttacttagtcaatggattcaaatgccaatccctttcagaaacaccctcacacacacccagaaagactgctctacaggccatctgggcatcccttaatccagtcaagttgacctgtgacattagctgctgcaactcattatttcatgtcttcagctgcgatattaagaaacatgatggaatccatcaacctacgccatcagcattcatcaacacaggtgcaacttaggttaaaagatgaggctttgggggaagatattcaaagcaccaagccctacttgtcaccaaaagcagaatttcagatcagtgggtggacattgggcaggaggcgctcttatgtggcatctctcagagagctctgcagggtctcatcccgatggctgcacaaggtggtgggtgacggggatgcccgctgagcctgaggcccagggcagcctgacagagggcctgtgtctcagccctctcgggcagaaggttaggaccaggcagcctggcatcttgatttccacagcccttttcctcatcctcttggtctcatgtcctgctctggactctctaactagctggttagttcctgaccaaggttgggcttcctccactcccacctctgtttctgtttcctaattttcgtgggctgcctatctctttcttagagtcttagaaataatggctagttcatctgtctgtagccatgtctatagtgtccataggcttaaaaatgttttcacagaggccgggcgtggtagctcacgcctgtaattccagcactttgggaggccgagtcgggcagatcacaaggtcaggagttcgagaccagcctgaccaacatagtgaaaccccgtctctactaaaaatacaaaaaattagctgggcgtggtggcagacccctgtaatcccagctatttgggaggctaaaacaggagaatcgattgaacccgggaggcggaggttgcagtgagctgagatcacgccattgcactccagttcaggcgacagtgtgagactctgtctcaaaaaaaaaaaaaaaaaatgttttcacagatgatccaggaaacgcactttgaagggtcctaaatctgctttccctcccgtgagcctcttgtgaatctgaagttctcagcaggttgccagccactaatagaacagagaaacacagaaatcaatgcgaaaacctttgttgctatgttcttcttacaaaaattacagacatgtcctaggtaagataagcatatgttctctgataatgatgatcaatatcattcttctctgaaatgcaatctagaaaacaggtccccagaggctgccctgatgggtggtggctgccagcagtgtgccctgaaggagactgatctggtcacatggccctcccaccccagggtggcagcacccacagacttaggagagacacacaggagggtgactcagcctggctctcaagaaagggccaaaacacccttggtgagaaagcacagaagacgctaagacaacccctggagaaaccaaaggaagaaagttacatgcaggagacagagcctaagcagacaagagctggaagattcccctggctgcggctggagtggaggaggaccacactcccagtgcagagccacccggcaggggcccatttgagttttgaagcgaaatcaccctttctgagtactctttgtgtgtcaggcatgtgctagctgttttgcatgcatggctgggcgcggtggctcacgcctgtaatcccagcactttggaaggccaagacaggtggatcacaaggtcaggagatcaagaccatcctggctaacacggtgaaaccccatctctactaaaaatacaaaaaattggccaggtgtggtcgctggcgcctgtaatcccagctacttgggaggctgaggcaggaaaattgcttgaacccaggaggcggaggttgcagtgagcctaggttgtgtcactgcactcccagcctgggtgacagagcgagactccatctcaaaaataaataaataaataagtcacaacaacctcatgagatagacatccttacttacagatggggaaactgaaacactgagggttaaataactcgctaaatatcccatggctggtcatggtgtagctgggacacacacaaacccaggcctatcaactccagtgcctacacgcttatccagtgcctctagagggacagacacagtactgaaaagtgcctgtgaaagacaaagtgtcacctgtctcattgcagtagtggacaaatggaactctgactgctcaggaaagaagaggtcggtgctcttggagcttcactctcttgtcccatgcaggtgcagggtagaggctacggatttcctgacacccaccctcctggccatcccctgatctcatcaccaggctcatcctcccactcctggccacgtgcctggaggttctcctgtctctgcctcaggtggcttttctggtttctgggccatctctcatggcctctgtgagccctgtcctcccatgactcacagtttgctccctgaatctcaccctcagactctaactggaggatccattccagctttcccgcatctcagtcccagtgagtggttctgtgtctgtgaagcctcagaagcagaaccaatgggatgatatagaatgtgggggtttattataggaatttgatctcatgcaaatgtgggaactggttagagtttatgtacgttttttgcttctgtgcctggtcagctgtgaggaaggacagatgacacaaagtgaggaaaaggacaagctcaccctggagaatgagtttggagccctcctgggcttctccctacctctgggaagcacctgtcaggtgaattgcaggagaagctggtgcctttgccatggagctgagcatgaactacctggcccagcagacagggaattgggagaaaccggggggaagtggttgctgcaggccgggttgctctcccatgcccaggaggtgggccggcaggtcagggacagtgcacctgggctgtgaagcttgtggtgcctgcactgacattctgagcaaggtggctgctgttttcccctccaccttgcaaatctcaagaatgggtctgggccaggtgcagtggctcacacctatagtcccagctacttgggaggctgaggcaggaggatcatttgagctcaggagttccaggctccgatgaagtatgatcacaccactgcactccagcctgggcgacagagtgagaccatgtctctaaaataaataaatgaaaaggaaaaataatggttttgctaggctcttttccacactgactgatgaggccaaagaaataagtgggaagaaggagttcatggaaactgcctggctgtttctgagccactgtcccctgtcccagaggctttgcttgggcagacagagggttcatcttactgagaggtggggaaaagggcaggaaatggagagaaaggaagaacaaatccctctcatttgatcagttcatttattggatgtttcttgttagaagctgagaataaagacatgcaaaagatgcagcctgacctctggaagcagacagtatcgattatcccaggcatgtgggaggagccgggtggactctcagggtctcatcgtgctgctctcccaggtcttgccttaggcaccaccattactgcatttgagaaatggcgctggcagtagttgctcctgcttaaaatgtaagggggcggccaggcgcagtggctcatgcctgtaatcccagcactttgggaggccgaggcaggcggatcacaaggtcaggagatcaagaccatcctggctaacacggtgaaaccccgtctctactaaaaataaaaaaaataggcggggcacagtggctcacgcctgtaatcccagcactatgggaggccgagacaggtggatcacgaggtcaggagatcgagaccatcctggctaacatggtgaaacctgtctctactaaaaatacaaaaatattagccaggcgtggtggcgggcgcctgtagtcccagctactcgggaggctgaggcaggagaatggcgtgaacccaggaggcggagcttgcagtgagccgagatcgtgccactgcactccagcctgggtgacagagtgagactctgtctcaaaaaaaaaaaaaaaaaaaaaaaaaaaagtaagggggcagctcgcaccattaggatggccactatcaaaaaaaaaaaaaaaaaaaacccagaaaataagtattggtgaggatgtggaaaaatcggaacccttgtgcactgttggtaggaatgtaaaatagtgcaggcactatgtaaaacaggatggcagttcctcaaaaacttaaaaatagaattaccatatgatccaaaaattccactgttgagtatacatgccaaagaaagcagggtcttgaagtgatatttgtacactgcgttcgaagcactatcattcacattaaccaaaaagtggaagcaagccaagcatccatccacagacaagtacataaacaaaatgtggtggattcatacaatggaatagtattgaggacaacatttctactaagtgaaatgagctaatcacaaaagaacaaataccgcgttattccacttatatgaggtgcctagactcatcaaattcacaaagacagaaagtaacatggtggttgccaggggccatgcagtggggaggggatggggacacagtttcagttttgcaagatgaaaagagtcctggagatagatgatggggatggctgcacaacactgtgaatgtatttaacactactaactgtacacttaaaatggttaaaatagtttattttattttattttattttattttgagatggagtctagctctgttgcccaggctgggggcaatggcatgatctcggcttactgcaacctctgcctcccaggttcaagcaattctcctgcttcagcctcccaagtagctgggattacaggtgcccatgaccacgcccggctaatttttttgtatttttagtagagacagggtttcaccatgttgaccaggctggttttgaactcctgacctcaagtgacctgctggcctcggcctcccaaagtgctaagattacaggcgtgagccaccacgcccagccaaaatggtaaattttattatatgtgtttttcaccataacttttataaaaaacctaaggagaaatgttgaaactaccaaggagaaggtgttattgagaataaactccaacagccgagacctgttggtcctctttggtcaactggagcaggtgagaggggatgccctgacctcaagcctctcctctccaattgtttcaaggtttgcttctgtgaaaaggaaaatggaagtttacttaaaccccggcatgtgttttattttgtcctaattgtgtagccaggcattcactgttctcattagttctgccaagtcagcaccagaggctggcgaggtggccgtggagatgaacgagtccttccagatggcagagagcggtgtgaggctgaggcttgtcatagtgatatgcaatgcccctgaactctgaagctgagaacttcctttgggaagctgggtgaccatctgcgaacacttccaccccaaacatcatcatcagtggttttacgatgatgtttgagttcctagtgtagcagttaaattttacagcaaaagctataatgctcctttatactttgttaaattatctttggacaaagagttatgggagaaggtgaagaatgaagaattcctttctgaaacacaataaaaagagtggatcaatgtttttcggtagctcctggggccgtcttcccctgacaatgtttctcaacgctgaaacacacacatggtcttgcagagccagcctctgagcgaggaaaagcttggcacccccatgtcctgagtgggctcaagttcaggtttccaaggccatggtgcccaagctacaggcagccaaagtttcagatgttaccatagctaattgtaatttactcagcttcatcctcacaaagctgaggacattaacactgtagttagcaccattttccagcaggggaactggggtttagacacagagttaggttttgctcaaggtcatgcagcaagtaaacgtgaaaaatgaggtttgaacccaggcaatctgggtttagaggctgaagactttactacatgcagcttgggctctggtggcagagatgtcaacgccatcagaacaatacagaactcatgaaagctccagttccagataggatgttgaggacaccacaatgtcagaaggtgtcacactggttttgtttttaaatcaagaaggtgctaaaaggaggcaatcagataataggagaaaaaaagtcactactgggttggggcacatgcatgagcctgcagggacaggaaggagggagggtaaggtatctccaccagaccctcaactcaccctctccctcctcctgggttcaagtgattctcctgcctcagcctcccaagtagctgggattacaggcgcccaccactacgcccagctaagttttgtatttttagtagagacggtttcatcatgttggttggtcaggctggtcttgaactcctgacctcaggtgatccacctgcctcggcctcccaaagtgctgggattataggcgtgagccaccgcaccaggcttccagtcccttcttttggcctctagttataaaggtaattgtaaccatgaaatatccaggatataagttccctttgcccactggtactttcgacttggtttatccacgttttcgtgcactctgtgtcttcttagtctatatcctatgatagttattctacgattcacacaatatccattctctcatttcttacgaccaaatttaacttcaaccttttctaactttgtgataccagaaaatcaaaatgatttatctctttccttctgtctcccaataacgcgcacacatgcacgtgcgcacacacacacacacacgtacaatatagtttctagaaaatgttcatctagctcggttttctggcccttaaccgaatgtgtgagtagtgtaaggatgcattttcttgatcctgtgctatgtttaaagcaatatgtctccatctgatcagggttatgtctctctacaaatgctggatttatgtaaatgccactctgtctccaaccagtacagcacatgatttagctgtcgttcagtgatgttattttggagaactgcatgagctctaactacagaatttaagaaattctatattaaaggagaagaaccagcatcagtgctggcttttacaaaactatttatttcaaaataattggagacccacagggacttgtaaaaataagaaatagagtttgttgagccctccctcaccttacttcctccagtggtgacatcttttataactctattgcaacatgagagccaaggaccaagaaattaacactgctacattacactgcaaccttactcagttttcacttatttttaccctgcattaatttgtgtgtgtgtgtgtgtgtgtgtgtgtgtgtgtgtgtatagttttatgcaattttaccctatgtgtagatttatgtaatgtcaggatcaggatacggaaccattctatcatctctggggaactatctcatacccatcctatccaggctcacccatccacccacccgtccctaacagcaaccactaacctgttctctatctctatagttttgtcattttgaggatgttttgaaatgaacttgtacaatattttttaaaaaaaccatttcaaattggctgtttttactaagtaaaatgaatgcccttaatatccatccaagctactgcatgcatcaatagttttcattgctgagtaatattttcttttatggatgaaccagtttgttcaactcttcaccctttgaaggacatttgggttgtttccactgtttggttattatgaataaaatcgctgtgagtgtacaagtttgtgtgtgaatataactttccatttcactactgggttgtattgttagtacatgcctagtttgttgttctctttttgagatgaagtctggctctgtcgctcaggctggagtgcagtggcaccatctcggctcactgcaacctccgcctcccaggctcaagtagttctcctgcctcagcctcccgagtagctaagactacatgtacttgccaccacacctggctaatttttgtatttttagtggagacagggtttcaccatgtcggccaggctggtcttgaactctgacctcaagtgatccacccacctcagcctcccaaagtgctgggattacaggcatgagcctccacacctggttgtacatgcctagtttttaaagaaacttattttccagagtggttataccattttcacacttccactagctatgtgtgagaattccagtttctcaacatccttgccaagatttcatgttatgcctatttttatattttagctatttaaaaaacaatttttttcttttcttttttattttattttttgctctgtgcccaggctggagtgcagtggcatgatctccactcactgcaacctccgcctccctcgttcaagtgattctcctgcctcagcctcctaagtagctggaattacaggcatgtgccaccacacttggctaatttttttgtattttagtagagacagggtttcgccatgttggccaggctggtcttgaactcgtgacctatatgatcaacccacctcggcctcccaaacttagaatggtttcttcatgttgttgctagtacataaaaatacaattgatttttctgtgttgatcttgtatcttcaaactttgctatactcacttagctctaggagttttcctagatttctgatagggtttggctgtgtccccacccaaatctcaccttgaattgtaataatcccgacatgtcaaaggcagggccaagtggagacaattgaatcatgggggcggtttcccccatactgttcttgtggtagtgaataagtctcatgagatttgacggttttataaatgggagctcccctgcacaagctctcttgcctgcctccatgtaggatgtgactttgctcatttgccttctgccacaattgcgaggcctcccagccatgtggaactgtgagttcattaaacctctttccattataaattacccaatcttgagtatgtctttattagcagcaggagaacagactaatacagtatcttacttagcattttttacctaatcaggtcatctgaaaatatggacagttttatttcttcctttttgagctgtatgctttttattttcttttcttgccttattttactgactgaaaacttgacaggacacatccttatcttgttccatatcttacaagaaaaacgtgagctttcaccattgagatgatgtcaactgtaggattttctgtagatgatcttactcaagtttaggaggttccccttcatacctagtttgctgagggtttttatcataaaatgataaagacaaataaaacaaatacaataaaaaaacaaataaaaataaactgtctttattgttgccagtcttgagataattttgtcatttttactgatattttcaaagagccagctttttctttgatttctgctcttctctttgttattttttccttcttttcctggtttcctggggtgggtgcttaatttttgaccttaggatctttcttctttcctaatataagcatttggtgctgtaaatttccctctgtgcagtgctttagctgcatgtcacaaatttcgatgtgatgtgttttcgtttcatgcagctatgggcacttttatttttctaactgactttttaagccattttaaagtatacaattcagtggtattagtgcattcaaaatgtcatgttaggccaggcgtggtggctcacgcctgtaatcccagcactttgggaggccgaggtgggtggatcacgaggtcaagacatcaagaccatcctgggcaacatggtgaaacttcgtctctactaaaaatacaaaaattagccagccatggtggtgcatgcctgtagtcccagctactcgggaggctgaggcaggagaattgcttgaacctgagaggcggaggttgcagtgagccaagatctcaccactgcactccagcctggtgacagagcaagactccatctaaaaaaaaaaaaaaaaaaaagtcatgttaccattaccagtatccatctccagaatttttttcattatctcaaactgaaactctatccattaaatggtaagtccttattccccgttttgctagttcctggtaacctctattctactgtctgtctatacatttgccagtcctaggtgcttcatacaagtgaaatcatacactttgcctttttgagtctggcttatttcactttgcacatgttttcaaggttcatcacatgtggtagcatatgtcaaaatttccttcttttttaagactggataataattcagttcatcgtatgtatgtgccatatttcatttattcatccatccattggtgggctcttgggttcttttcacctattgtgaataatgctgctgtgaacagcaatgaacaactacctatatttctgctttccattccgtgtaagtatatacccagaagttagatgactggattgtaaggtaattctatgtttaactttttgcacaactcaaactgttttccacagtgactgcatcattttacattcctaccagcagtgcacaagggttaaatttcttcacatcctcaccaacacttgtcattttcaatttgggaggataataagtcatcctaatgggtatgaagtaatattacattttgatctgcatttctctagtaataatgtttaacatctttgatgtgtttattggccatttgtacagctcctttggagaaatgtctattcatgtcctttgcccatttttaaattgagttgcttgtggtttgttactattgttgttgagttgtaggagttctttatatattcaggaaattattctatgtgatcttactctctttacatttgtgaaggtttgttttttatgatccaggttttcatctatcttaaatgttccacggtgcttgaaaagaatgtatactatgctgttgtcacttagaatattctatcgatgtccattagatcatgttgattgatggtgatgttcagttcatctgtatctttgctgattttctatctaatatttctatcaattgctgacagaggggaattcaagtacccaaccataattggggaatcgtctagttcttttttcagttctgtttttacttcatgcattttgatgttctgtcctttggtgtttggtacatgcacatttaagatcactgtgtgtttttggatggttgcatctttatttatttatttaagacagatcctcactctgtcatccaggctggagtgcagtggcaccatcttgactcactgcaacctctacctcctgggtttgagtgattctcctgcctcagcctcccaagtagctgggattacaagtgggcgccaacacacccggctaatttttgtaattttagtagagacagcatttcaccgtgttggccaggctggtcttgaactcctgacctcaagtgctctacccgcctcggcctcccagagtgctgggattagatgtgtaatccactatgcccggccaggttgcatctttttatcattatgtaatgtccctggtaattttctcttggaagtctactatatctgttatgaagccactccagttggcatggcatatcttttccatccttttatattcaatctacttatgtcattatagtgagtttcttaggtgcatcacatagatgggtcattttttaatccattcttccaatctctgtttttcagttcgtcactaattatattttacagagatcatttatattaaaaataattattaatcgattagggctcaagtctaccattttattattgatctcctgtgtgttgtctccagttcttgttcctttgtgtacctcttcttgatttcttgtggattacctgaatgttatttagaatttcattttgatttgttcataatgttttttattcatttgaataattttcttagtgtttgctctaggtataccaaaatatatgaagcatatcgcagtctactagtattgacatttaccatagtcaagtgtagaaactttacttccctttatttccctttgccctctccaatttttaaatatcgttttaagtacttctatatacactgagtaccataccagatggcattataatgtttgttttaaccatcaaatataattgcataaggagaaggatagtctattacgtttgccctttttacttattctattgtttttttctttcattctgtatttcctttcctctttctgtcatctccatctgctatcacttgcattttgtttctttagctgttctttaaaagtagatttggctgggcatggtggctcatgcctgtaatcccagcacttcaggaggccaaagcaggtggatcacttggggccaggaattcgagaccagcctggccaacatggtgaaaccccatctctactaaaaatacaaaaattggcggggcatggtagtgcacacctgtaatcccagctactcgggaggctgaggcagcagaacgcttgaacccaggaggcggagggtgcagtgagccgagagcatgccaccgcactccggcccgggtgacacaatgagaccctgtctcaaaaattaaaataaataaataaataaaatttttaaaaagagtaaatctgatggcaacaaattctattcctttgtctgcgaatgtctttatccttcagaaataaatggtactttcactagttttaggacatagggtttataattctttatttttcagcccttgaaaaatgctgggctacttcctcctggtctccatggtttcagatgatgaacattctgtcattcaaatcattgttcccctgtaactaattcatcgtttctttctagctgctttcaattgtgttttttggggatttttgtcttcagttttcagaagttttattataatgtatcttgatgtggattcttttggttttattctgtttgagattcacttagctttttgaatctaagtttatgccttgcaccaaagttggggaattttcagccattatttcttctggcgccttttcagcttcacaaattttctcctatcctggaactctgatgacataaacgctagttcttttgtcattgtcctgcaggttatgagactttgttcatttttttcccccaggctattttctctatttatttatttacttagtttttgagacacagtcttgctctgtcacccaggctggagtgcagtggcatgatctcagctcactgctacctccacctcccgggttcaagtgattctcctgcctcagcctcccgagtagttgggattacaggtgctcaccaccacgctaatttttgtatttttagtacagacgggatttcaccatgttggccaggctgatctcgaactcctcacttcaggtgatcccccgcctcggcctctcaaaatggtggcattacaggcataagcctgtattatttagattgagtaaattttatttctctattctcacattcactaattttattctccgtcatctctaagctagtacggagctcattcagcaaactgtttctttcagttcctgtatttttagttctatgattttcatttagttccttttttacatcttctatttctttgctgagactttctatgtttacttgtttcaggagtatttgtaattgcttgttgaaactttttgtgatggcggctttgaaatcttcatcagcaaatttcaactgctgaatcatcttcatgtgtgcttttgtttgtggtctgtggccattcaagttattttctgggttcctggcatgacaagcggtctttgattgtatcttggagactttgggtactatgttagaagactcagggtctgtcttctttaaagtttccattttagcaggcagtttccccgtttagacttaggatgcaagtcccttaggctgcgggtccaatgacgactgagttttcagagcccctgtagtgctactgtagtcaagtttgttagtgtgccacctgcggggcactctgcaatgcgtatgtacatctgcatgtgtgaaactttcacactggtccagttctaatcttttgatgtgttgaactggtcagtttttacctttgggttgatcagctgtctgcgccagaccttctaggcagggcttaaagaatcattttctccagctttttcctatctgagatcctcttccccatgtctagctgggggtggggacagaagtccagactccccactccatctctgtggacaccatgccagtagggaaggaacttgctgccaacagctgccaacaacttgctgccaacagctgccacctggccctggtggatgggagtgggagtccacaccccctccctggcctctgctgatggcaccagcccaggctgcctgctgctgctgggcggggcataggagtctagactctcctttgagacttcactgcagtgctggagttgctaaggtgtgcacttagctggaggtaaagtggatattatcaaaaaggacttccgtcctgtgggctgcccatttccctgtctctgctagataaataaggtttttcttcaagctttattttccatctgtgccttatggtggttctggattgcaggcttctctagcacccagtccagaatatagcaaagataaaaagaaaacccagagtgtcgccaccacctcagtcctcaagtcttgagttctcgaaccaggctgcctgcctctttttacttttccaagggtccttatgattatccattaaattatttccagggtttttagttttacttaacaaaaaggagcagagggaagtgaatctacttgtctaggaccagaaagccagctgcttttttatgctgtcttttattttgtagctagaaactcctggatttttttcctcagaatgttggagtcaatgtttcttttattttcaaatacagaaatgtcttataacctgtttactaaaatgataaagaatcaggttaacagaggccaggcacggtggctcatgcctgtaatcccaacactttgggaagctgaggcaggtggatcacctcacatcaggagttcaagaccagcctggtcaacatggcaaaactctgtttctactaaaaaaaatgcaaaaattagctaggcatggtggtaggcacctgtaatcccagctactcacaaggctgaagcagggagaattgcttcaacccaggaggcagaggttgcagtgagccgagatcccaccactgcactccagcctgggcaggtcccaagagcaagccgcaaaggtccctggcaagtctcagcccgtggctggatcctccctctgctgcctctacctgttggttttacatcaggtttcccacctggtttcttcctggaagcccagtcttgcagggggtacaggtgattttggacggtaatgcagagagaccagccactctccactgtgagacaagttgcatgaggatgaggcttcagaggtctggcctgaccttgattcaggtgcgatgtcaggaaggaaacaaacgttggcattaggattgcatccagcatgaatgaattgtgattgctgaatgagtaaacttttagttggaggaacatttccactccaaactcccgtgggagtaagttcttcagaaactgccttcagtgtgccccaggattctgtgaaagtgcagagactggcaccaccaactgtcagccttctccagggcaggatgacaacatgtgtcaggtcccactgaattgcccaaaaggctgaataagcacatgtaccagctttccaaggtccccgaggcttcagggagagggaggggttggaggaaatattgattccaacttttgaaagaaaagaaaatcaacattaacatccatagatctataagatgtattttatgtcaaataatccattgtaattcaatttacatgtaggaatataaaattgcatttgatgttggggggggcgggcattgaaatgtatttggtatgacatggagtggagccttcagtgtttttaaaagggcccagctgaaccaggaaaggagggacaaaaatagaagggtggggagggaaaagatcagcttcaatcagttcatgcacaattttgcaatcagaaatgtcagaaggaaactattttagtgtccacacacttaagttttgtgaaatggggtgagggggccgggcacggtggctcacgcctgtaatcccagcactttgggaggccgatgtgggaggatcacctgagctcgggagttcaacaccagcctggccaaaatggtgaaactgtctctactaaaaatacaagaattcactgggcgtggtgacgggtgcctgtaatcccagctactcgggaggctgaggcgagagaatcgcttgaacccgggaggcgaaggttgcagtgagtcgagatcgtgcctctgcactccagcctgggtggagacttcatctcaaaaaaaagaaaaagaaaaaacggggtgggggtttcatgaggggctcactgctcggggtcttacctgggttctgccagtggtggggctgttactttccactggcagccacaccaagctggccacacctggcacctctggtgtggtggctggggatgccctggagacgaggtcttcagatgccccttcatgtgcaccagatgccaagtgcctgctgtaggggagggtggcggagaccctaaggttcggtgtgcaggaggattagccggtttgccagacaagcttagagcatgtctttaccccacttgccctgtggggtaagggtaagaactgtcaccctttggtgctggctcctgtgccaggaccccctcccaggacaagtgcacacgatcccctcccagcagagcttggatatagccctgcaacttgcagtaggctccgcccacctcttccctacaacccccactcctgtttggggctgtaaaagtagaaaaaaactcccataaaacccaaaatgctttttctactctcaccccacaaaaatcaacacagaagacttctatggccaaatgtgcagggatttctccccaaaaataaacaagcaatcggttctgcagtggacaccagctgggtatcccccaattcagttccaatactgtctacctggagagagtatcagatcccagagggtgagggctctgtgcccaagactaccccccttcccagccccgctagataccagcaacaagtccggggcctccagaactcctgcctgactggcttcaagttggggtccccatggctcctcttttggtttgattaatttgctggagcagctcacataactcaggggaacacttaacttacctttagtggctgatcacaaaggacacaaatgaagagatgcacagggtgaggcatggaagagggagcacgaagcttctacgccctccccagggaccaccctccaagaagctccccgtgttcagccatccaaaagctcctgccatccagcctcccgagtagctgggactacaggcgcctgccaccacacccggctattctttgtatttttagtagagacggggtttcaccgtgttagccaggatggtctcaatctcctgacctcatgatctgcccgcctcggcctcccaaagtgctggtattacaggcatgagccaccgcacccggcctccttagggtttttatggaagcttcatgactgattaaaccactggccattggtgatcaactcaacctccacgttggggggttgggctgaaagtcctaaccctctaatcctgcctaggtgttgctcgtaaccagccccaaccttcctaggtgctgccagccagcagtcagttcattcatgtgcaaaaagacatcactgtgtagttgctaaggatttcaagagtcatgtgccaggaaacggggttcacaatatcacaggggccatgctgggtctcccatgagcctgagacacccagcctcgtccatagtgtgctcaggagtcctgcactgtagggcgggatgtgcaccccgtgcatgggacaggggacacagaggacacagaggagctcggaagtgtggcaggactaggccacgatgacccattctcctgccaaggaatagcgagagaaggctccccagggtgcagccacagcacacctagggggtccacggaaacagaccccgtgtaggcctctccctgtgagttcaggtcatctgagactgatcattcaagccccagccatgcgctgttgatgatgtgagaccacagcttatccaggaatcaaaacagaggtgtctgctccagccacctgtgatttatgggctttaattgcagacctgctcctgtcttataaaatcaggatggagcctccactgctgaggcaaggaaaagatttgtctaaaatattggctgctgtcgtcgatactgggacctcttgagccaggtcccttccacattctgatgaggtaaggctgctctggaagaaaaagccctccagaacataaatctatttgacaacaaatgtctccttctcatggcgagccaaatccccctgtgcaggagccagagatacagacacagaaaaagaggagctggttcagtcttcaaggacagaaagaaagagaaactctgcctggtgctaaagcaggccctctttgcagctcattccaagcctaaaccagctcctgcaactctcaccaaagctgtagctcttcacggggatggaaaagcaatctcgtcgcgtgtggccattgggatgattttctcctcccctcatgcctgctgtggacgaggggcgtttcctcacgtcgcaactgttgctttggccaatggaacgttagcagttgaggtgtgggcaaagtcctggaatgtgcttgtgcgtacagttggctcagctcctgggctctggcccttcaccatgagaacacgtccaggtgctgctgatcaaaggaggaggaacccgtggggcacatcagaggccgccctgcagcttagagcccagtgcagctgagcccagtggcctgcacagctgtgcatgaagaatgaacattggttgctacaagccactgaaattgtgaagttgtctgctacacagcaatattatgccagtagtccatcaccacatccaggactttagagaagcaagaccctgatacgacgctcctgccaccatctcagaattatctgaaaaacaaccctgacaccaacataattttttctctctcacaaattcaaattatattattccctcagtctgtgagtcaggggttattttatttttaaagtttgctgcctcctcagtatatgtaatttgaccctaattttgtaagacatgaatatagctaaatatattccagagatgagactgaaatgctcaagatggtgacagcagtatttctgggttgagagatttagagtgacttatgttccaccaaaaacatttctatatttgttcacattttctataatgtcattattttatgatcaactatatatacttgatttttgaacagataaagcttaacataaacatggtttaaacataaagtttactccccagaaactttgttcagaatgtcaaaaacacaggacaggaagataagtaaatcctcatacagcagagtcactgttcaccctgggaagggaggtaactgccagaaacccaaacaaagggatcctcagatgctgttggcctcttctgcttaggaactgatgtcagaaaatatttgtccttgagaaagccagcccctgattaaatgttactatgctctgatacaatgtcagtaaatcatttccaaaaccccaaacactgaaatagtagggggtggcaatgaccacttgggtgatttctcacctgggaggacatcataaaggtaaagatgagcactggggtacaaatgtgcttgcaatggggacatatgcagtgagcagagagtggggcacacacctccctagactcatttctcagaaacacatcaggtcacccactttctctccaaaagcagaagtcagattgagctcatgttcccttgtccatgaataactggatgtgtgaggttatgacagatttagaacctgccaaaatcagagtgagtgagagagtgagtgtccttcctgggctagaacatactctacttctctgaagttgaacaagatggaaatttcataacctcaagggacagagagaacactgcccactgcagatggtaatattcaggggcatcctccagggttcctcaggtgggcagaaccagaatgggtcatgggatgagagatctattacgggaacgagaccttgccagttgcaggaggagctagagaagagaaggtatgagagggaagtgtgcagagcggaggagtcaccaactagctggtctgagaaatcaagctcgtcgcactgccaacgctggtccatgaaagcagaggagacatctacagcaagctatttcttcagccaagcacctgaagatggtcggagttattgttggccaggaggatgccccacagtgaagaagaccaaatggacatggagtacaaggacacgcaggaggctgtggcacctccaagtgtgtctgtcactgcacctaactgcgttgaccttcagagggtaatggctgctgcctgctgatcagaattggctcagtcctttctgcaaggaaggaaggggaaagggaaatcaaaaggaatctggccttgtcagtttctatggcgaggctctgccagcaaaaaacagtggctatgggccaggcagcccagagtgcctgctgcagggccagctcttccagctaagggcttctccacctcggcactgctgatgtttccagcccagtgatccttggtggtgggggtttatcctgaacaccactggtctctatccacaggattccaagggcatagtccctgcaagtcataaccaaaaccatctccagacattgccaaatgtccccagagtggtggcagacaaaaccctgccagctgagaaccactgttttaccttctgcatctcagagtgctgaatcaaggtttaagaacataatgaagcttattcagtcacattgtgctcactaaaaacattgttttaaaaagttttagtgagaatagaaaggatttctgtgcaattaataaaaaacaaagggctgggtgtggtggttcacacctgtaatcccagcagtttaggaggctgaagcaggaggatcccttcaggccaggagtttgagactagcctaggtaacatagcaagaccccatctctacaaaagtttaaaaattagccgggcgtggctgttgcctagcaagtaaataaatccagtgttctatttttctatcactgtggcattcattgcctttcctttaacaattctggagattccactaagattgccttgtcgattctccttgtctggagcagtggacagcccaatctgaggagtgtgagccctcagctcaaagggctgagcccacggtcaggggctctgctgctttttgtggtgagtcactcaacagcaataatgcctttcttgtttgtggagttataacctgaatcctggtcagcagtttccaatgcatgactcagtgtgagactttgttgggatgctaaagtgatttgttgagttttcaaccttgatttgtaacttatctattaactctcttttgaaagaaatctttgtcgtggaggagtaaataagctactgagcatctgcagagtcccacggctctctaaatttctgcctattccatttatagtctgcacttcttgttcaaatgcatgttgggtcgtggagaccaatgctgtccagaaaaaaactggccgagtcttgactcaatctgaaagtctctctgttacacaaaattgtcatttgccatacttatcataattatctgtcggtttgtctctctgtttcttgtcctaaaagttctgccgaaagtttgtgattgaagcatttatgcaaaagtcagacgtaacaattaaaatggtaaattttatgttacatatattttatcacaataaaaaataagtcaaatgctggctgtacaaactaaaagtaaagagtgagacatagacttacgggaggcagctagagcagttcttacagataaatttataattgtaaatacttataataacaaagaaaaaagatctcaaatcaacaacttaaccttccacagtaagacactgtgaaagaacagcaagctaaacccaaagcaagcataagaaaggaaataagaagaattagagaggaatttaatgaaataacaattagaaaaacaatagagaaaatcaacaaaatcaaaagttggtttttgtttgctttttttttttttttttgagacgaagtctcactcttgtcacccaggctggagtgcaatggcataatctcggctcactgcaacctctacctcccaggttcaagcgattctcctgcctcagcctcctgagtagctgggattacaggtgcgcaccaccacgcccagctaatttttgtatttttagtagagatggggtttcaccacgttggccaggctggtcatgaactcctgacgtcaggcagtctgcccgccttggcctcccaaagtgctgtgattacaggtgtgagccaccacgcccagccagaagttggttcttgtaaaagatcaacaaagttggccaacctttacctaggctgactgacagaaaagagagagaaatcaaattactaaaatcagaaatgaatgagaagccattgccaccaacttacagaaataaaaaagaattgtgaggaaatactatggacatctgtatgccaacaaattagatgacttaggtgaaatggacaaattcctagaaagacacaaactccaaaactgattctagggaaacatagaagatataaatagtcatagaaaagagattgaattagtaataaaagaaaaaatctaggccaggtacagtggtataagcttgtaatcccagcactttggaaggctgaggtgggtggatggtctgagctcagaagtttgagactagcctgggcaacatggtgaaaccccatctctacaaatacaaaaaataaaaattagccaggttcagtggtgtgtgcctgtagacccagctactctgggagatggaggtggaaagattgcttgagcccaggaggtcaaggctgcagtgagactgcactccagtctgggcaacagagtgagggcctgtctcaaacaaaacaaaacaaaacaaaacaaaaaaaccaaaaagaaaagaaaagaaaaaagattcccacaaagaaaagcacagcactgaggaattctaccaaacatttactaaagaattatactgatctttcacaaaatcttccaaaaaatacaacagaagccaacactttccaactcttcctatgagcctgataatagcccaataccaaaaacaaagatatcacaagaagagaaaactacagaccagtatctcttatgagtacagatgcaaaaattctgaacaaattactaccaaattgaatccagcaatgtgtaaaaaggatttacaccataatcaagtgggatttatcccaggaatggaaagttggcttaatatctaacaatagattattttaatacaccatgcctttacaataaaggaaaaaacacacaacaatcttaatagatgcaaaaaagcacttggtaaaatttaatactctttcataatttaaaaaagtcacttttaaaaactagcaatagaagttcctaagcctgataaaaagcatctatgaaaaacttacagctaatatcatacttagtagagagactgcctacttttcccctaagatcaagatgtctgttcttgccacctctactcaatattataccggaagttctagccagcgaaattaggcaagaaaatgaaacaaaagtcatcaaaattggaaaggaaaaaataaaaccatcactatttgtagattatctaatcctgtctttacaaaatcctaaggggtctaagaaaaaaattaatattagaactaataaatgagttcagccaagtttcaggatacaagatcaatatcaaaaaatcagttgtatttctatacattagcatgcacaatcaaaaaatgaaagtagaaaaacaggctgggcacggtggctcacgcctgtaatcccagcactttgcaaggctaaggtgggcagatcacttgaggtcaggagttccacatcagcctggccaacatggtgaaaccctgtctctaaaaaaagcacaaaaattagccgggcatggtggtgcgcacctgtagtcccagctactcagaaggctgaggcacaagaatctcttgaacacgggaggcagaggttggagtgagccaagattgcgccactgcactccaccctgggcaacagagtaagactctgtctcaaaaaaaaaaaaaaaaagaaagaaattagaaaaacaaattcatttacgagatcattaaaaggaataaaatacctaggagtaaatttgacaaaagaagtgcataacttatgctctgaataccacaaaatgttgttgaaagagattaaagaaactctaaatatatgcaaaaacatatcccatgttcatgtattcaaagacttaataatgttaacatggcaatattacccaaattgatctacaaaattaaagcaattcctatcaaaatcccagctgacttatttgcaaaaattgacaagctgattctaaaattcatataggaactcatggacccaaaatagtaaaaaagaaaacattttggaaaagaagaacaaatctgtagcacttaaaattcccaatttcataacttaatgcaaagttaacaataatcaagacagcgtggtattggcataaggatagatatatagatcagtggaatagaattaagaatctagaaatgaacctgtgcatctctatattcaactgattttcattaatggtgccaaaaccattcaataggggggagagaataatcttttcaactgggtgtggggaataacaattatatatatacatatatatatacacacacacatatatatactgtatatacacatatatacatatatacacatatatatcatatatacatatatacacatatatatcatatgtacatatatacacatatatatactatatactatatatatactatatatatagtgtatatgtatacatacatacatactatatatttttttgagacggtgttttgctctgtccccaggctgaagtgcagtggcacgatctcggctcactgcaacctctgcctcccaggttcaagcgattcttctgcctcagactgccaagtagctgggactgtaggcacacgccacgacacacggctaattttttgtatttttagtagagatgggatttcaccatgctggccaggatgatctcgatctcttgaccttgtgatccacccgccttggcctcccaaagtgcagggattacaggcatgagccatcgcgcctggccaataatattcttttcaacaaatggtgctgggacaactggatgtctacatgcaaaagaattaaattgaacccctacctcattccacatgcaaaactgaaaggcaagtaaaaacgaattaaagacctaaacgtaagagctaaaactacggaattcttagaagaacacatagacttaaatcttcacaaccttggattaagcaacattttcttagagatgacaccaaaagcacaagaagcaaaaccaaaagtagataaattggacttcactaaaactaaaatttctgtatttcaaaggacaacattaaggtagttaaaatacaagcacagaatgggagaaaatatttgcaaattatcctatcaactcaacaataaaaacacaaataacacgactgaaaagtggacaaaggattagaatagatagacatttctcccactatacaaatggaccaataagcacacaaaaagatgttcaacatcattagccaccagggaaatgcaaatctaaaccacatgagacggcacttcacatccaacagaaaatctagactcgaaaatacaagtgataacaagcatcaaaaaagacatgaagaggctgggcacagtggctcacgcctgtaatcccagcactttgggaggcggaagcaggtggatcatgaggtcaggagattgagaccatcctggctaacacggtgaaaccccatctctactgaaaatacaaaaaattagccgggcatggtggtgagcacctgagtcccagctactctggaggctgaggcaggagaatgatgggaacctgggaggcggagcttgcagtgagccaagatggggccactgcactccagcctgggtgacggagcgagactctgtctcaaaaaaaaaaaaaaaaaagaaagaaagaaaaagacttgaaggaattgtaactctcatacactactgatgagaatgtaaattggtacagtcactttggagaacagactggccattcctcaaatggttaccatataccccagtaattccatttgtaggcgtatactgaatataaataaaaacatatgcctgcataaaagcttgtacgtgaatgttcaaagcagcattattcataatatccaaaaagtggaaacaacccaaatgtccaccaactgatgtatgaataaaataaaatgtggtatacattttactggatatcatttgtcaagaagaataaatgaactgatacatgcttcagcaggaatgaaccctggaaacagcatgctaagtgaaggaaactcgttccaaaagaccatatgttctatgattttacttttgtgatgtgtccagaaccggcaggtctttacagatagaaagtagattaccggttgccaagggctgatgggacaatgacaaaggggtgcagagttcctcttgggaaaataaaaacgttctaaaatggattatgtgataaccctatgaatatatactaaaggccatttaattgtgcactttacatgggcagattgccagtatataaatgatatctcaataaagccggttatcgaaaggagtcatatagagacagggaagtaaacgctcaaagggttctgcctgaattcatcatcacagaagtgagtcctggccgggcgcggtggcccacgcctgtaatcctagcactttgggaggccgaggcgggtggattgcctgagctcaggagtttaagaccagcctgggcaacatggtgaaaccccgtctctactaacatacaaaaaattagccaggcatggcagcatgcacctgtagtcccagctactcgggaagctgaggtaggagaattgcttgaaccggggaggtggaggttgcagtgagctgagatcatgccactgccctccagcctgggcaacagagcgagactccaagactccatctccataaaaaaaaaaaaaagaaaaaaaaagaaagaaaagaaaaagaaaagtaaagaagaaaaataaaaaaaagaagtgggtcccaaagttactaacccagtcagaagaaattgggatcagccaggcatggtagctcatgcttgtaatcccataattccagctctttgggaggccaaggcaagaagattgcttgagcccaggaattaaagaccagactgggaaacacggcaaggtgccatctctgaaaaaagagaaataaattgagttcattgggagaccacaaacttaagaggaacaccaaatacacactatagcaggacattatcagagaattcttagaaatggagcatatggaaaagaaaagaaatccatggccctccaatctgcagagctcactccaaaccttaaagccagggatgatgagacgtgagaattctgtttctcagttaacctagaattaagtctaaatggtgaaaaaaaatagatgtagatcctgccaacagcagggactttggaaaaatgtgtccagcatcaaaggaggactcaaaggcaaaagcattttgaaaagaaaaggcaaagcatgcaaggcagtcagacatcaggagcatttacccaccaaatcagaaagcacgaatgttgaaaaccgcagcaatgatgcctccctgcaacctcaccaaagttgccacattacagtagcttgttcatggtggggaaccagtcgtttttctcatgtgattaccttatttatttatttatttatttattttgagacagagtctcgctctgtcacccaggctgcagtgcagtggtgtggtctcggctcactacaagctctgcctcccagggttcacgccattctcctgcctcagcttcccaagtagctgggactacaggtgcccgccaccatacccagctacttttttgtatttttttagtagagacagggtttcaccatgttagccagaatggtctcaatctcctgacctcgtgatccgcccactcagcctcccaaagtgctgggattacaggcgtgagccactgcgcctggccgtgattaccatatttctgaaagacataatacttttgtgggaaatgctcagtattttattgattctgggtactagaataagacatgatttatttcagagtgaaatatgtgaggtttttcctgactgtggcaggtcacactggaagcagggcaaatgtcagatttatgtttttggtcttgtcttgaaagtaaaaggccagttgtagtcaacagagctcttgctggcataattccaaaggccataagagtgcttggctatgtcttctgttctctgattcagaagaaaagaaatcattgattgtgttagctttctattgatgcctaacaaattacctcaaaattagcagcttaaaacagcacccgttgatcacctcaccattctggaggtcagaagtccaggtggcttgactggcttctctgctcaaggtctcacaaagctgatattgaggtgtgggccaggctgggtttttatctgaaggctcgaggaataacccatttcgtgcttactcgggatgccggcacagttccgttccatacagttgtaggactggggagcttgtttcctttctggttgtcagctaggggtgaagagccactgtccttctctacgtgaggccctctgtgtcttcaaaccagtgatggcacttcagttccttcttgtggttgggctctttctccttctgccttctcttctacctgcctcttctcccatcagctggggaaagtcctctacatttaaggactcgtgtaattagattaggctcacacagataatctcacaggttaatctctgaatcttaagttcagctgacttgggaacttaattataactgcaaaatcccttgttggcagtacctagatgaacatttgatggaataaccagggatggaaatcttggggcatggaggcacttttaggacatggcctaccatatctatagacataaagagacacaaaggcctatttctagttgacacaagggccactctgtctatcctgaaccctactgcaataaaacaatcactcactcagagaaatcaatgggttactacagtgggtatttcaaacccacttctctatccattgccttgaccaccatatgaggaccaacagaagacaacattgatttctcctccgtggtttcatgcctctccacccacctggaacaggccctttatataaatgcagctgtcatattaagtgcccacctgcaagaaccacccaatttcacagcatgctatttctacacttgactttcctaaacttgcctagaccatgactcttgaaactgtagataacttactctggctggtacattgcaatttatgagcaaaagctctgttaatggaggacatacaataggaacagagcctaaaaacacacaggtagatcctctcaagtccttgcctaagccactctaatgtcctctgaaagcagaagttattcaaggaataaaaccaattatacattctcaaatcaaaagtgtctcacagaagtctatgtatcgcctttttacaaacctaatggaaagggatgggatgttcatttgttcaagacttaagaaacattcctaaagttatccctaggtttcccgcagtgccccactctaatgctattctatctccagtttcacttacaggcaaatgtactgtaatgtacagtacaggcaaatgtactgtgagagacctttctcagccttctttggcatatctgtaaatatagtcgataggtattttctttatttagaatgactaacagtatacaggtatttgggcagtaatacctcagagacaccttatattccttccagtctttaaatcatgatttaaaggacatactcccaaaagggtacaatttcattcaatatagaagactttgcctcatatatacctctcccggaaaaccctccagaggactcaatccaccttttaaaggagcaagtggctacatatgataaagcctcaaaggaaaaatgaccattttgccaagaggtgggacatgatttaggaggtgacctctccaccaacaggcacactctacccaaaaattggacactcataggatttgggaaacttaagaggtatgaaaagcaatggattcccagtttttccagcgtaacttgactcctccatgaacttaacaaaaacacgcaaccagaaaacttccttgatgaaactgaccttgtcactttgaaatctaaatcacaacaggccccaataccggctccacctgaacatcatcatcatttaccttacgcccatttggcacatttcctttagctgaagcaaaaaggaggtgccatggggtaccaaaaagaggctttagctcaacaacatgggaagtaccagaaaccgctcctgatttaggcacttctctagactcagtggctagggttttcttccttgttatgtgccttaacagtggttgcaaaacggtcagtgcttctgtagatattatccttgtcgcaccattaactccatgggttgcccaggctgttcagtccatactactgacaagcaacagccagcactgctctgcaagcccattagctcaggctggctgctgttgttggtctctcatgttacccaccatgtgtcagtgttatcatctcagtcttgcagtattgcttccaccacctgaagaagagccccaggactatagtacagcaaacatgaagtcgagtatttccaaggaagatctagttgatgttctcctagagaatctgcagcaagtgttgcttttaaatgatcaaggtcaataccattgaagttacgcaatgattacataaaactgtattagggccgggcacagtggctcatgcctgtaatcccagtactttgggaggctgaggcaggcagatcacctgaggtcaggagttcaagaccagcctggccaacatggcgaaaccccatctctactaaaaatacaaaaaattatctgggcgtggtggcatgtgcctgtcatcccagctacttgggaggctgaggcaggagaattgcttgaactagggaggcggaagttgcagtgagccaagactgtgccattgtactccagcctgggcaacaagagcgaaaactctaaaaaaaaaaaacaacaacaaaaaaaactgtactagatgataacctttcacccaaagttgagccatctcaaatagtagaactagtagcccttaccagagctgatgccaaaagggacacatgtacacacacacacacacacacacacacacacacacagctattatgccttggtgttgtatataatttggtgatgctatgggactgaaggaatagctgacctcatcagagaggcctaaaaaaagggagaaaaaagtagatttgttagaagcactgatgctctcaaaagaggcatacaattaaaagttaaggcacatagtacaagccataataaagaaggtgatgggagtgcattggcagatattaaacaaaggaagtgcacttttctccttgttcttaggagttatttatgatgaaggaaatgtaaaaacatgaatagatttttttacatacaatttatttcagacagagtatttagccctagattcaagaaacagaaacactgggccaggcgcgatggctcacacccataatctcagcaccttgagaggctgaggtgggtagatcacctgaggtcaggagtttgagaccagcctggccaacatggtgaaaccctgtctctactaaaaatacaaaaactagccaggcgtggtgatgtgtgcctgtaatcccagctacttggaggctgaggcaggagaatcgactgaacctgggagatggaagttgcagtgagcaagatcgagccactgctctccagcctgagtgacagagcaagactccatctcaacaacaacaaaaaaaaaaaaaaaaaagaaagaaagaaagaaaaaagaaagaaaagaaaatagaaatgctggctaaaatcaggttgttctgtcaatttcagtggtctctaatggagcaaggatggcctcttgcttacaccaaaaatctgaggtagaaattgaccaaaatgcacaacagagcttctaccacggataagagttggtggggacatttccccttggtaactagagatgtgaaaggtatatgcctcatctgtactatcataaccacccccacaaaaaaattgtgatggtgggacacaggtctgagctatatcccagaggacttttaaacacttgaaaatgggctttatccactttcccaagtcacgagattatgcatatgcgctaaaggttgcctgtaaattctctggaggtgagctcttctcaagtagaaaagccactgcaataactaaacttaaaaaaaaaaaaagttagacaatggtttttcccacctgggaagccaatcatactcactaatattaaaggtactcatttactggagcagtcataaagggacttggtgaggtgttactacttcgtcaaaaatctaggccacacgcggtggctcacacctgtgatcccaacactttgggaggctgaggtgggtggatcacctgagatcaggagttcaagaccagcctggacaatatggtgaaaccccatgtctactaaaaatacaaaaattagccaggcgtggtggtacacacctatagtcccagctactcaggaggctgagacaggagaatcacttgaacctgggaggcggaggctgcagtgagccaagatcacgccattgcagtccagcctgggtaacagagtgagactccatctcaaaaaaaacaaaaaacaaaaaaaaaaaattcttgttacccttactcttcagtttccagaaaaggtagaggtacaaatgtaggtacacaacttaaattggtggtgatgtgcgcctatgatcccagctactcgggagcttttcatttttctttcttattgcttcttgctttctgtactgcttctgaggcaggaggattgcttgagaccaggagttcaagagcagcctgagcaacatagcaagaccctgtttccaaaaaaataaaatgaagtacaatacattagccagggatgatatgcacctgtagtcctaactacttgggaggctcaggtgggaggattgcttgagcccaggagtttgagactgcagtcagctatgattgcactactgcatgccagcctgggcaacagatagagacctctgtctctaaaacataaaaataataaaactggttaagttatctgaagctcttaaacatccatggctgagaattttacctctagtggccatcaggtcagcctgttctggaacttacagattgtaaccttatgaattaacaactagaagacccatgcactggtaagttttaccactcgtaattgattggagcttgcttcaggcagacctagctaaatactgtcaaagagaaattcaataatcattcttatcttccatgattgcaaactagattttcaaaaacttcaccttcaaaacctctacactccttcaacctagatattaggtattctggaaaagacaccaattggaaatattctctagagacattctggaaaggatcctaggaaggtgatagcagaagcggcccatctagaatggcagctgccaagatgccagctgcagcagacaggcaggcctgggcctcccattctcagagtgggctgaagccccgccctccctgggtacctctgcagctgccctcccaggcgcaagacccgggcatctctgcagtctgcacccttgggggcctgggaaggccccccatctccacaggctcaggagtctctgctctgctgcctggcctcttcccagctcagcaccctctctgatcttgaagcatggttggggccaagcccaggcactgtcacagcccagctgggtgtatacacactcggggcagcaccgacacaccagctccctaccgcctcagccccctacaggctttgggcacccacgagcatgggaggggaagccaaggaggggctgagggcagcttggtgctggcctgcaggtgccccttagttcaagcagcctgggcaccatggacagcagcaggacgcagacgggttcctgggtggcagggggtgggtccccagtgaagccccaccttctggctggagaagatctgaagcctgggggccaggccgccagtcctgtggattggagggggaactcatggtgctttttcctgggcccgcccatggctgtccatggaacaatcagcatgcacttccccaccctgaggcccataaaagccccaggctcagccagagcaggagagacaatgggacaaccagctgcagagagagccttcccactccagcaatgaactacctgcagagaggagaaacacactccaggtcctcctttctgcaaagagctgtggaaatgacaggacaacctgccagcagagaggggccacccaccccagggccttctcctctctgctgagggctgaacactcgtcaggacaccctggttgcaaaaaggagctacccacagtgggtccctgagctgttctactgctcagtaaagctcctcttcatcttgctcaccctccacttgtctgcatgcctcagtcttcctggttgcagggtaagaactcaaggtgccaaatggcaagtctagaagtgctgtaacacaaacagggctgaaacacgccgcttgctctccacattgcaggtgaagagtgggaaagaagagctgaggccctttagggagcccagacctgggggctccccaagccagggctgtgactccctctttgaggccctgcggttcttggagtctctgagcttccaggcactactgcattccccccagggccagccaaagctgcttgtggtgtgcctcctccagctgcagccttgcagagagctgctgcctgtgctggtacctggaaactgctcctgctacttcaggagccggcccacttgactgtgtgcagcggccggactccacactcacttgctcatgcaccttgccactccacgcctggctcaaccttggcagccgtggatccaggccggtagcatgagccaagtacagcctgccaggctgagtgggaggaataagctgaatagactggatcaaaagtcagacaaaggcaccaccaaccacagaggtttctggccagaaaaataacacccaaaagatcccataagaaaggttcttaataacagacatcagtaaaactgcaagaagtgtatccttggatccatgtatcccctgtgcaaaaagatggacaaagaaattgatttggttgcaagggccaactgggagtccatatcactgggaatctcaaactgcaccttaacacaaaacaaaacaaaacaaaaaactccagatgaagaaaactgtctgaaggttgacagcagctacccaagtactttgcaccacactgattaatacttgaagcagcttccactcaagatcatcagagtaagacccaatgaccaaaaccacaaattttcttttctttcttttttcttcttgtttcttgcttctgtctctaacccttatatcgatttggattcctttttgttgatttaaactggctgacagtacactgatacagtttggctgtgtcccacccaaaatttcattttgagttgtaatccccataatccccacacatcaagggagagaccaggtggaggtaactgaatcatggggcagtttccccaatgctgttctcatcatagtgagtgagatgtcatgagatccgatggtttgataagtgtttggtagttcctcctgcattccttctccttcctgccactttgtgaagaaggtgccttgcttcccctttgccttccgccatgactgtaagtttcctgaggcctccccagccatgctgaactgtgagtcaattaaacctctttcctttataagttacccagccttgggcagttctttacagcagtgtgaaaatggactaatacacacaccaacaatgccttattcatgttttttattcttgtccttaatacacgtggtccagagagagcttacgcttaccagggcattttccatctaagagtgtaaagctccagaaatcggaaagaatctggatttttaaatgcatctctgacttctaatgtgtcccttattactggatatcaagcattccacatttctgctcaagatttccaagcttatgatgctaacatgttctgttcaatcatgtggattgaacatatttcatttatacagatcagtatagctatacttatcttaaataatttataatattgctataattatacttatcttaaatattagacccatccaaggcctaaaatcttgtccaaagtttgaactgagaaactgatcaggttttctctaattgtttttgatgtttctacttaaatttttgtaattgtacactaaattctgtgactaacggtaaaattgttttctcaaactttcgcattcatatcatggaaaatttcatcagacccaaatcaaaactggaaactaaaatttggaccaattaccaaattttgtgccaatactacattgaggaaggcaaacatgtttgtgcggttggagaattcatatatattaaacaattaacattcattgtatactgaaagtagaacatacgctttgacagaaagatttcatataaaagctgtactgaatctggtcagtttttaacttgcagaaagacatgcattaataagaacttacatgaatttttaaattccccatttctatcaagcatgttttacacccatcctacgctctcaatggaatgcaaatctacttggaggaattagagatggtgagatccatatctctatgtaaggtatctttccttatcttgcagtatacaaaattcctattgccatggtaatcatttcaaataaaactatatttgcactctaggctaaaaaaaattagcctgaactttcttgataaagtgttactagacaacagaattgcctttgattatacactagcagagcaaggtgatatttgtgtcctgactaatacctcctgttgcagctggatcaatgagagttccttacataaaattcaaggacaagccaacaggttgtccaagtgggataatgcatacagttgaaatctagtctcatggcttgagtttgacaaaaggaggggtactttgtatctattagttatgctgtttctatctctgtttctattcactgctgttgtcaaatgatttgtaaacagcttctgaaatgctgctgcaccatctcaacaaacatcaaatgatcctgaattgaaaggattctaaagtgatctgaaaaaacacaactgaaaaattagcacctttggtagagcgtgatgatggccccaattcttcatccctccagtagcctcagctttttccatgtgccctttctctttgagacacaggaccacaggactacagctgagagtgtaacaagaaaaactctctggtagcacaaccctaatctatgcacaaggtaaaactagagaattttgaatcttgtggttcacttagagtcaccatagcaacaacagaacccaagcccaactcaaatatcacctatattgactcagctccccacactagcagaagaggatgtgctcccatctctatgtaaaacgccgttcattttagcctttactgtgtaacacaacatgttttgctttcaactaaaaattacaagacacacaagaaagcaacaaaaagcaatccccagtcaaagagagcaatcaagagagccagacttagatatcactggatgttggaactgtcagacaggaaatttaagataactattattaatatgtgaaaggcttgtggaaaaattcacaacatacatgagccaatcatgaatttcaactaaaaaataaaaactatgagaaagaatcaaatggaaatgctagaattaaaaaacaaaaaaacaaaaaacaaaccgggcacagtggcccacacctgtaatcccagcacttgaggaggccaaggggggtggatcacttgaggccaggagtttgacaccacctggccaacatggcaaaactctgtctctagtaaaagtgcaaaaattagctgggtgcagcggtgcatgcctgtaatcccagctactcaggatgctgaggcatgagaatcacttgaatctgggaagcggaggttgcagtgagcgagatcacgccaccgcactccagcccgggtgacaaagcaacactccgtttaaaaaaaaaaaaaaaaaaaaacaactatgtaggccacaggcataacacttttaaagagcagaaagaacaaagctcccacctttgaattctatacccagtgaaaatatcttacaaaaataaagaataaagaatttttcatataaacaaaaattgagagaatgcattaccagaaaatctgtgctatcaatataagaaatgttaacggaattttttttttttttgagacagagtctcactctgtcacccaagctggagtgcagtagcacgatttcagctcactgcaacctccacctcgcagctttaagcaattctcatgtgtcagcctcccgagtagctgggactacagacatccatcaccacagccgggtagtttttcgtatttttaatagacacgaagtttcactaggttgcccaagctggtcttgaactcctgagtgcaggcaatctgcctgcctcagcctcccaaagtgctacaattacaggcgtgggccactgtgcctggccagtaaatttttaaagtagaagaattctgatagcagacagaaacttgggccaacacagcaaatggaaagatgctcaacataatttaccattatttgccagggaagtgcaaattaaaaccacagtgagagtccagtacacacgtattaaaatggctaaaaacctgacaccaccaaatgctcgcaaggacgtggtgcaacagactctctcatatcttatcttgcttgaaagaaagcaaaatggtaaagccactctgaaaaacagttcgtttcttctaaagttaagcatgtacttaccctatgaccctctaatctcactgctaggtattacccaagtgaactgaaaactcatcttcacacaaaaacctgtacacaaacgtttaaagcagctttttatgaccacaaaactccataaatagcccaaatttccctcaccttgtgattatgtgtctgcagttgctgccggccagggtgttcgtggtctcgctgccttcaagaacgaagccgggccttcgtggtgagtgttacagctcttttctttttgagaccgagtctcccgctgttcctcacgccagagggcagtggcgcggtcttggctcactgcaagctccgcctcccccgttccggccattctcctgcctcctcctcctgagcagctgggactacacgcgcccaccaccacgccgcgccagctttttttttttctttttgcatttttagtggctacagggtttcaccgtattagccaggatggtcgcaaatctctcgacctcctgatccacctacctcagcctcccaaagcgcccaccagtgttacagctctcaaagacggcagtgttacagttcttacaaatggcacggacccaaaaagtgagcagtagcagctataaagaagcaaaggacaaagcttccaccacacagaagtggacccctgcgagttgccgctgtcggctgggggggcggggggggggggtggccagcttttattcccttattgtccccacccatattctgtttctgtcctatcagagtgcccttttttcaatcctccccacgattggctacttttagaatcctgctgattggtgcattttacagaacgctgattggtgagttttacagagtgctgattggtgcgttttacagagcgccgattggtgcattttacaatcctcttgtgagacagaaaagttcctgattggtgcattttacaatcctcttgtaagacagaaaagttccccaagtctccactagacccaggaagtccaactggcctcacctctcaattagataaccaaattgtgacatatatgtatgaaatactatctatagtgtgtgtatgtatatatacatatatataatgaaatattactcagcagtaaaaaaggaatgaactacagatacacataacagcatcaatgaatctcaaatgtgctattgtgctattaatacgtgaaagaagtcagattctaaaggccatatgatatggtagaatgggaaaaacgttaaaacaaatcaggagttgccaatgctgatgatatggtttggctgtgttctcacccaaatcttatcttgaattataatttccataatccccacatgtcttgggggggaccaggtggagataattgaatcatggagcagtttcccccatcctgttcttgtgatagtgagtgagttctcatgagatctgatggttttataaggggtttcccccttcactgggcactcatttttttctctcctgccaccttgtgaagaaagacatgtttacttttccttccaccatgattgtaaatttcctgaggccttagcctccctagccttgcagaactgtgagtcaattaaacctctttcctttataaattacccagtctcgagtatgtccttatagcagagggataattgacgaatacaactgggaatttaggaggaggtggttatcaaaaagcggaatgggggaaggtagaatttttaggggtgatagaatcatcgtgtatcttgattgtgtgggtggtgggtgtagtggttacacaactgtataagattcaaatctcatagaattctatactaacaagaattttactgtatataaatcacacttcattaaatataaaacaaatcaataaaaaaaaacaatctactcaatacaacacccaagactgatctgaatgtgatctgaatctgaaagcctgataattctctcatcctttcaggtcaacctttcatctctgaatgaggtaaggacattataaaggactataaaaaaaactttataattatagcaatacttgcctggggtttgatcaaacatgaatattattttgaccagccaaagctgttaaatgactataaactttgagcaatacactagcaaaggtgataaacaaccaagaggtgatcctcacccaacctaacgaaaattctttcccaactaaagagcaatgagactcacttcacacaacatacagatggatgcattctgcccagtccaggctgtgcgctgcaattgttaactggcaaaatcacaatgaacctgtcctttctagcacataaaattcctgatttttttttccctgtggggatccactcaattgaaataaatatagtgcttacattttcagtcagtaggtggtccttatcattcctttaataatacacccagaggctgggcacagtggctcatgcctgtaatcccagcactttggaaggctgaggctggcagatcacgaggtcaggagatcgaggccatcctggctaacacggtgaaaccccgtctctactgaaaatacaaaaaaattagccaggtgtggtggcatgcacctgtaatcccagctactcaggaggctgaggcggaagagttgcttgaatccgggaagcggaggttgcagtgagccgagatcacgccattgccctccagcctaggagacagtgcgagactccatctcaaaaaaataaaaaataataataataataatacacccagaaaaccactatcaccactgtctaggtcatgaaacagaacagactggaaccacagtaataatgcattttcccaaaatattacattcctgcctccctaaaggtaactactatcatacttttaacaccatagactagttttgcctattttgtagcattgtgtaaattgaaccatatagtataaataattttatgcctcaaccttatgcttatgggagttgtccatattacagcatgtgtaagtagctgttcatttttattaccgtatgatattccattgcacgaatatgccactatattttttttttttgagacagagtcttgctctttcacccaggctggagtgcagtggtgctatatgtcagctcactgcaacctccgcctcccaggttcaagcaattcttgtgcctcggcctcccgagtagctgggattacaggtgtgcaccaccacacctggctaattttttttgtatttttagtagagacaaggtttcaccatgttgcccaggctggtctcgaactactgagctcaagcaatccgcctgccttggcttcccaaagtgctaggatttcaggcgtgagccaccacacccagccaccactatgtttatgtacctgctatcagtgaacatttaaattgtttttggcttgagctattataaataatatgcaaggataaataaatgcaaggatctttccattacactatggttcaaatgtgccccctccaaaattcaagtattgccaatgtgatagtattaagagatgggacttttaaaatgtgattcaaccatgagggctcctttttctaactgaaattaggtgcccttctagagggacttgatggagggctttgctctctcttgcccttctgctgtccatcctgtgaggacacacacacaaatgccctcagcagatgccagtgacttgatctttgacttcgcagcctccagaactgagagaataatttttttttctttataaattactgagtctcaggtattctctcacagcagcacaaaattgactaagacatgtacctttcagatgtgtatcttttgggtttcgaaccatgtgactatattacctcttcaaaattgaatcaaattaaaattgtaaagtaatgaacaaatccagtgagcatttctttggatttctttctgacaagtagtagtgcaaatacactctgtgtgaaaagtagttttaaagtagcactttattgttatcattggcaattagaatccaataattacagttgacccttgaacaacacaggtttgaactgcgtgggtccacttctatgaggacttttttcaacccaacgaggattgaaaatacagtattcatgggatgtgaaacctgcatacacaaagggccaacttttcttataggtgggttccagaaggccaactgcaagatttaaagatgcacagatttgggtatcctctggcagtcctggaaccaatccccctcagataccaagggacaactctataattattgtaaagcattaatgatatttacatgaattaagagtgtggttgtaattacagcatttttttgctgatttgtaaagaattctccatttaatgaaaattagtaaacaaggccaaagatgttttaactgaaaaaggaaattaaaggttcatttgaaagaatcagacaattgcatcctctgagaagatttttttgtttgtttgttttgttttcttttgagacggactctcactctgttgcccaggttggagtgcaatggcgagatctctgctcactgcaacctctgcctcctgggttcaagtgattgtcctgcctcagcctcccaagtagctgggattacaggtgcacaccaccatgcctggctaatttttgtatttttagtagagatggggtttcagcatgttggccaggctggtcacgaactcctgacctcgtgatctgcccgcctcggcctcccaaagtgctggcattacaggtgtgagccaccacacccggccgagaagatgtaattttatcacataaaattcagataccctcactgtgttttaattcagctggctaatttatctgagattatactttaaaacctgagtataaacaaaaaagaggtatgtaacattaggttgactgttacaattcagtagaatatttaatgagctacacacatacacacacatttacaagcatccaaggctataatacacagaaatcataaaaccaatggctgacagtctccacttcattattactgtttactgtaaggtcattattaaagtagtgtgaaaactgttgcccaatggaataactgttgttttccatttcaatacaaacgtagtcagtgacacacacattaacctttaaaacacccatgttttccatgtccatgtctacctaagacatcagaaaactatttacttaaagaaaatgcgccaggcatggtgtattacgcctgtaatcccaacactttgggaggccgaggcaggcagatcacttgaggccaggagttcgagactagcctgggcaacatggggaaaccccatctctactaaaaatacaaaaattaactgggagtggtggtgggtgcctaaaatccctgctactggggaggctgaagccagaggattgcttgagcccaggaggtggaggttgtggtgagccaatatcgtgcaaccgcattccagcctgggtgatgggagtgaaaccctgtcgcaaaaaaaaaaaaaaaaaaaaaagaaagaaaaaagaaaatgaaataaaatacagctgcataactgaggctcacaaagctactctgccatgggttactacaggaaaatggagattctgggagaagaaatagtatatacatccaaaagttttggttttgctgcagtcttattgtgcctgcttttaaaaaatccgatgtgaagattttccccaaataaaaatattttttataataggataaagttatatcccagcatagtgatattcatgaccatcctcgcccctcctttgtatggtctttgtgtcattcttgacaggtccaccattttagtgcattacaccctgcaacctggctccagacagaagactccctcttcttctcagaagcctgcctgggctgcacagggccacctcgcccagcagtgttcacaactctgtctgctggctctctgctgcccctctccatccatgccacgcacacgagcccataaggactgcctcccgattctttttcttttttttctttttttgagatggagtttctctcgtgttgcccaggctggagtgcaatggcgcaatctctgctcactgcaacctctgcctcctggattcaagcaattctcctgcctccgcctcctgagtagctgggattacaggcatgcaccaccacgcctggctaatttttgtatttttcttagtagagacatgttggtcaggctggtctcaaactcccaacctcaggtgatccgcccgcctcggcctcccaaagtgctgggattgcaggtgtgagccaccgcgcctggccaggactggctcctgattctaacggttgcccggaatcccgtgcccagcccagctgagctctgtacccactagggtacttgatctgctgtaattgctctgggcctcagcctctccatgcagcacacacacacatgcttggtgtgcttcacaaggatatagggagagctttaggagaggcagacttgtcttctaagaatcatttttagtaataaatagcatggtggggtggcgggtgcagtggctcatgcctgtaatcccagcactttgggaggccaaggcgggcggatcacctgaggtcaggagttcgagaccagcctgaccaacatggagaaaccccatctctactaaaaatacaaaactagctggattataaatcatgctgttataaagacacatgcacatgtatgtttattgcagcactattcacaatagcaaagacttggaaccaaccaaaatgcccatcaatgatagactggattaagaaaatgtggcacatatacaccatgaaatactgtgcagccataaaaaagaatgatttcatgtcctttgtagggacatggatgaagctggaaaccatcattctcagcaaaccatcgcaaggacaaaaaaccaaacaccgcatgttctcactcataggtgggaattgaacaatgagaacacttggacacaggaaggggaacatcacaccccgcggcctgttgtgggggagggggaggggggagagatagcattaggagatatacccaatgtaaatgccaagttaatgggtgcagcacaccaacatggcacatgtatacatatgtaacaaacctgcacgttgtgcacatgtaccctaaaacttaaagtataattaaaaaaaatacaaaattagctgcgcatgatggtgtgcgactgtaatcccagctacctgagaggctgaggcaggagaatcacttgaacccaggaggcagaggttgcagtgagccgagatcgcgccattgcactccagcctgggcaacaagagtgaaactccatctcaaaaaaaaaaaaaaaatagcatgggggtatgaagcctcatattttgataataaattgctcccagcatatattacaatctgatgcattcttaaatgtgaattcctttgtgctataaacgttaagtgcctcattttctcaatgctgtgagcttttaattctgcagcatggctctgtgactgtgattgtgagtagggacggctgtgttgatgtgcatgtggtcattccacaccttaaacgtgagaggtgcactctggtctgtggtcaacagctaaattcctctatctctttaaacttcactgcaccaaactggagaacccacagctgctgtttcccaatgggtctgggcagtatttgaggctggtttgcaagccaactataattttctgtagtggaaagagactctttatttttctctctctctttttttttttttttagcgctcctgcgcactgcctgatgttccctccctgggctggatgccgacgctgggagactcggaagccgcgtgtggaagatggcagtgtgggtatggcctgggtgcttgcgtgatggggtggagggagtcattatccccaacacaaacgcgcccactgactcggacccgcattggactgtgggacctgggcagactccctaaaatgtgggttttgtgatagttataacagcctgcattgactggtcctcggccagtctcagggtctttggcaatatttggaactctcttggccctttgtcttttgatacttatctggccaaatttggcctgaatggaccaaacttctgccttttctgtttctgggcaggcactgttgggcactgccagagagaaatctcaaagtcagatgttacactgtctgggatgcagctgcgcccagcaatcctggtgtgtccccaatccaactttctctgccaccttctggagtggctatttcaagtctccggttttctgaagtccttaagtctctctttccacttcaaagagaacattgcagtcatcggttgggaacttgctccaagtgaggagcaactgtgcccaccctcccatcctctcccacacctggggagttcatggctagccctgccctttgggcactggctcccagccagagacctctgcaggggcagtgccccatctcatgccctctctttcctgcaccttcctctctgctagtgcccttcttctgcgtatctggctgtgtaggagaagttctctatcagcagagcctagttcaacagttaaaaaaaaaattcaccataggtttcatgccctgaataccacttacagagcagctgctgggtacttgcaatataggcaaaatgcagatcttgctcaactcttctggtgtctgttaactagccattgcgctcccctagataaaatggctctctctagaggggtgacacagatcattcatggtgggtagcagacatcaatcgctaccacttgttttcttgctggtggtaatggagaccctccagggaacccttacacccctctgaatctcctcgtgggaggaaaactgggttgtgctctgaaatgtcgttaaagtcatatttggagagctgcgctgactctgaggagctggctgagatctctttcttcctgaacagcatgccagctgccatgcaaccattcctcacgcaggcagcacaggggaaagcagggaggccacatcttggactctaacgtaatgattttttttcctgcttctgtggttaaacacatttagaggacctgttttgaaggttcctatgttcctgtctgcgttatgcaaattataggcacgtgtatgttaggaatgcaaggaacttgtttacatcatctttttttttttttttttttgagccagagtctcgctctgtctcccaggccggagtgcagtggtgcgatcttggctcactacaaccttcgcctcccgggttcaaacaattcttgtgcctcagcctcctgagtagctgggattgcaggcacacaccaccacacccagctaattttttgtgtatttttagtagagatggggtttcaccatgttggccaggctggtctcgaactcctgacttcaggtgatcctccagcctctgaacccaaagtgctgggattacaggtgtgagtcaccgcacctggcctacatcgtcttttgtgaaaaaaaaaattatttatacacttgaatgtctaatcagcgtttcaaaggtaacatgcccaaaactaaattctcagtatccctcctccccagccaccttcatcccagcaggggtgtcaccagcagctcaggccaatgatccagcagtcagacttgactccgctcatgctctctcacccatctaacccatcagcaatattactgggtctgctttccaaatccaccctcattacacctccccccactcacccccaccctcgcccagactgccaccatggacagttacagtggccttctaaaggtcatgtctcccccattgtcttctctcccaaattctattttccatagacaagctagactattttgatcatgaaaatctcactgtgctgctccctgcttacaataacctcctctcccttatggaatcaaatctgaagtcctcaccgtgcctgcaccagccctccagcatccctgtttcttgggcctgccaggccagtccccacctcaggacttttgcacttgttatgtcctctgccaagaaagctcttccctgagttatcagttcctggagtggccttccttgacactgtagtttcccagggctgctgtaaccatagactggagggcataaacaatagaaatgtagtctctcacagttccagagccagaaatccaaaatcaaggtgtctgcagggccacgctctctcgctctgaaagctctgagaaagaatctatcttacttatctttctcagcttctggtggttcccataaacctgtgatgctccttagtttatagacgcgtcattccaatctctgcctccattgtcacctagcactcccactatgcctgtgaaccttcccttcttataaagacaccagtcacactggattagggcccactctaattcaccatgacctcatgttaacttgattacttctgtgaagaccctatttccaaataaagtcacattcacaggtgccaggttagggcttcaacatatattttcttttcttttctttcctttttttttttttgaggcagagtctcactccgtctcccaggctggagtgcagtggcgggatcttggctcactgcaagctctgcctcccgggttcatgccattctcctgcctcagcctcccgagtagctgggactacaggcgcccaccaccatgcccggctaatttttttgtatttttaatagagacggggtttcaccatgttagccaggatggtctcaatctcctgacctcatgatctgcccatcttggcctcccaaagttctgggattacaggcgtgagccactgcgcctggcctttttttttttttttttttttgagatagagtttcgttcttgtcacctaggctagagtgcaatggcgtgtggtctcagctcactgcaacctctgcctccaaggttcaagcgattctcctgcctcagcctcccaagtagctgggattacaggcgcctgccaccacgcccagctaatttttgtattttttaagtagagacaaggtttcaccatgttggccaggctggtctcgaactcctgacctcaggtgatccacccacctcggcctcccaaagtgctgggattataggcgggatccactatgcccggctgtcttcaacatatgtttttgggagacacacttcaatgcatgaaaacatcctatatcctatagatgtagagtcgctatttgctctacatcttggcctgttttcttcaccccatgtcattttccactatctgaaactatgccccagaggatagtggcagctgtctaaattagaatctccctacccattctccttaaaactgtacaggtgagcaaggagagaagacacccattgctcctgtctacaccacatctagaaggcagagaaaggaaaaagtgtcttaaaaaagtaataataaggacccagcaagagagcaccctagccaatcaatcgtggaagaaaagggtgtcgttgattaaagaaactgcccttcactctagcaacagaagagggagcagttgatctgcacaaccaacaggccgctcgggcctctaggcctccactgcattgtctgctattgccagtccggggaaacgcaacagaaataaccaccaccaatcacaaagcagaaaaggagaaccatactttccagcagatggcgccacttcggaaaacagtttggtgcgtcctcaaaaaattaaacatataattaccgtgacccggcaattccactcctaggtatacccaaggcaaatgaaaacatgtccacatagacacttgtacatcaatgttcctagcaatattactccttaagagccaaaagatggaaaccactcaaacgcccgtcaactgatgaattggtgaacatgttgtggtatatatcgatacaagagactatttgcggtaaatagggatgcaatactgattgatactacaacatggattaactttgaaaacattgctggggctcggaagctgatgccccgaatttgatgctttgtacatgctgaactgaaaaaggagcttcaaggtctctctcctccctcctgccccaaagcataggcttctctgacattcccttatctgtctaaagtctgggtctatgaaagaaaaacaatcacctccagtcacttccctgagttttcattaactgcacccatatctcagaaaggaaaactaaagtcggtcaacacacctggacagacttttgtcacaaaccattgtctgctctgcaggcccagcagactttaccgcagaccgtggtgtgttcttcaagccctttgaatcttccctagtcatcatttattgcccctccccagaattcctcttctcccgctcccataactacgaccagggaagattcaaagggctaaaaatacaaaaattagctgagcgtggtggcacatgcctgtaatctcagctacttgggaggctgaggcatgagatttgattgaacccgtgagatggagaggttgcagtaagccaagattgcgccgctgaactccagcctgggcaacagagcgagactccatctcaaaaaacaaatcaaaacaaaaacaaaaaacaggtgattgtgtcatgggggctctgcctttgtgaatagattaacccattcatgaactgatggactggtgggttaatggattaatgtgttatcacagagtggaattggtggctttataagaagagaaagagacatgggccagcatgttcagccccctcgccatgtgatgcccggcaccaccttgggactctacagagtccccaccagcaagaagccctcaccagatgcagccattcaaccttggacttcccagcctccagaagtgtaagaaataaatttcatttcttagcaattactcagtttcaaatattctattatatgcaacagaaaatggacagagagagttcttaaggaattccccatcacatccgaggcttatccagaggtgatccttgtctggttccccaggaggctcctggaggaaaggaatggacactgtccaccaccccattcattggatgcagggcccgaagggaggacctgtggagggttttccagcggctcccttaaaaggaacctggagagaggtgattgaattacttcctcagtgcatcttatttgttaatgacatgctcatttcaatgatccatgtcatcccggtccctattaccataaataacgaagcattagctgtacgtggcagtggctgtctggagcagcaaagagccgatcccacggtgtgtctgccctgtcaaaatcatgttggctgtgcttaaaaatgacactccagcctgtccctgcaatccccatgcgttttcatcatgagtcagaacttcaagatgctattcattccgaagccatgtcagctcagctgtcaagcaagtttatcgcatcttgtatttatgataaacttgagtgacatgcagattttgaatatcatattctaaagccattttaatctaggctaaatgcagcctgtcaaattcccctgtaaggcaggatccatggtgggggctggggactgaagggaggtgacagcagtgcggttggcagacaggggagagggaaggtaagcaacagagaaaggtgcctgggttcccaaacagggttccagaggcaagtccactctgcctagaagtaagatggctctggggcaggacgcatgaagggtctcgcccagaacagtggttccagcggtgattcccagggacctatagaaaccctgaagggtggggaagcttgagtcacaagatgtttcaggcctttcgaggactaggtatttgtgaacacaggccagccttggaaattgaatatgctctcgacttacaatgccaccacttaagaggttgttgggctgggggttactcattcagggcactgttgtcccttctgggatgagaaaagccaaattattacacgctgaagcagatgtgtggggcccgaggtttatgccacccgggaactctctttaaagaaaatgaaaacaaaaattgtggtagagaattgctcgggtccctccaaggagcctacacaaagggcctgcagtgaggggtcccagtaccctaggcacagaggaccatgagctgcccagggcctcatgcctggggaaggctaagatgtgaagcatggtgatacaataagaaacatagatttggtccttgtctctgttcctggcacagagggcctaagacctttggaatctctgcagtgagaataatgaatgttttttgtgtactaatgagatgactggtggctgggagcccctgaacagcttcaggatgagggctggtcccagaaagaccaaggcaggattaggaggttggaactttcagccccactccccgcaaacctcctctggggagaggagacaggctggagattgggttaatcaccagtggtcaatgattaatgaatcatacccatgtcatgaaaactccctaaacattcctgaacaacgaagtctggagaacttccaggttggcaaacacagccatgtgctgacagggtggcacaccccgactccatgcggacagaacctcctgggctccggacccttccagacctagccctggctgttcgtctgtgtccatggtaataaactggtaatagtaaataagtgttttcttggtttctatgagctgttctagccaattattgacctgagggaggtggggattgtaagaacctcctgactttgtagccaagtcggacagaagtgtaggttctctgagtacctaagacttgggactggcgtctgcggtgtaggtgatcttgtgggactgagcccttgaacctgttcaatctgacattagttagtgtcagaattgaattgaatcataggacactcagttggtactgagaactggctggtgcgggaaaaaatcccacatttggtgtgagaagtgtttgagtaaaaacagctcaagcccattcttcatttctcagcagggtggcttttgtttgctttgctgttccaacatttcattactcatctgggtcccaatgggcctttattaagaaaagaaaccttttaacataaaaattggctccagatctgagccactcatttcccctgaacctctctggggtccttgtgggctttctgtttggacaggtgatcccagcgattctcccagcttcagaggctgagaggctgtgatccccatcaaaggcagcacatgccacagtgtcccccaaggagcccccgtctgccttgaattccacctacagtggcacagaattggcagtgggcacagctggctgccatggcttccaggggctggaaggagacggtttactgcagggattctttttttgtttgtttgtttgaaacagcatctcactctgtcgcccaggctggagtgcagtggcgccatcttggctcactgcaacctctgcctcctgggttcaaatgattttcatgcctcagcctcccgagtagctgggattacaggcacacaccaccatacccggctaattttttttatttttagtagagaggaggttttgccatgttggccaggctgatctcaaactactggcctcaagtgattcacccgccttggcctcccaaagtgctaggattacaggcatgagccaccgcgcccggtttactacagggattcttatccaagggcctatggatcccacaatggcatgtacaatttttatttttaaggtcttcttttctgaggaaatcagttgtccaattttcaaatgggtccttgactaccctcaaaggttaaaaatgatttccaggtgaaaaataaagaaaaacactgttgcattctctattttttttttctaaaagtcaaatcaagtatgggaaattccagttatccagggtgcctcaaccagggagcttctggctgcttgaacatggagtcaccacacacggtccatgtgtaattgcccaatgggctctccatacccactgcctagacagagccgatttatcaagacaggggaattgcagtcgagagtttaattcacgcagagccggctgcacaggagactggagttttattactactcaaaccagtctccctgaaaacttggggatctgggtttttaaggataatttggtgggttgggggggttggaaaatggggaatgctgattggttgggtagaagataaaattgttgctggaaaggggtcccaatccagacaccaggaaagggttcttggatctcacgcaagaaagaattcagggcaagtccatcaagttggtgactccataggcagggcagtggcatgagctgctcgagggagtatacttagttacttcttgattatatgctaaacaagcggtggattatacacgagttttccaggaaaggggaaggcaattccaggaactgaaggttactccctcttttagaccatagggggtaacttctggacgttgccatggcatttgtgaaccgtaatggtgctggtaggagtgtcttttagcatgctaaacattataattagagtataataagcagtgaggatgaccacagctcattatactctaattattaaaagacgtcgccatcttggttttggtgggttttggccagcttctttaccacatcctgttttatcagcaaggtctttatgacctgtatcttgtactgacctcttacctcatcctgtgactaagaatgcctaacctcctggggatgcagcccagcaggtctcagccttatttcacccagcccctactcaagatggagtcgctgtggttcaaacacctctgacaaaatcacggaaagtcgaagctgtcctcttttgctgaatcagttcctgggtagaggccacaggatcccatgtggtgccagctgatcatcgatcatcatgtgcagggtctacaaatcatctcaagcactgatcttaggccttaccatagtgagtttattctcaggagcaatttgggatggctcagaatcttggagtctccagatgcatgactcctaaaccctaatttctaaccttacagctaatttgttagtcctgcaaaggcagtgtagtccccaggcaagaagggagtttgttttgggaaagggctgttattgtttttgtttcaaagcaaaacaataaaccaagttcctcccaaagttagttcatgcccaggaatgacaaggacagcttgggggttggaagcaagatggagtcagttaggtgagatctctttcactgtcatagttgtctgttataattttgcaaaggcagatctaccatttctctgaaggttgagtttgggatgtggtagcctttgagtacccgtcctgttgctgtgtgtgtgttcagggcaatccaggaaatctggagaaaccagagtgtgtggtcccccttccccatttctctagtggatcaggtaggagggtgactgaggaaatgtgtcctgggatacttcctgcctcccagggtgtgtgggactcagcccttccccagcctgcagaggatgggggggggggggggctttgccagcagtcaagtcctgtgccccaggggaccaggaagcctgtatcaactcctcgctaccccagccagaagcagcaaacgctccaccctgtcctgctgcctgatgggcagagttgttttttttgtttttgtttttgttttcagacacagtctcattctgtcgcccaggctggagtgcagtggcgcaatctcagctcactgcaacatctgccttccaggctcaagcgattctcctgcctcagcctcccgagtagctgggactacaggtgcccgccaccatgcccagctaatttttgtatttttagttgagacggggtttcaccatgttggccaggatgttctcgaacccctgacctcgtgatccgcccgcctcggcctcccaaagtgccgggattacaggcgtgagccaccgcgcccggcttgagcacagacttttaatcagattttttctttctttaaattcctgtgagaccagccgcctgagggattaagaatatcgagggatggaagggagagtaaaagaacgggcacttttccctagggaaaaggaggcatgccgggggggcggagggaaggagggggtgtggaggagggaaggagggaaaagggggagggaggagagggaggagggggcgcggaggaaggggcgggcttccccctgccggcctcccttccttccccgctgcctccgcctctcgcactagcgccccgcacctgtggcgcccctgctccgcccagtcccgcggcctcctcgcccctagtccccggcgctccccgccccttcccgtgggatccgcccctccgccagccccgctggcttcccctctccgccaccccggactcagaacctcccctcccccgccggggcctgggcgcgcctgcccttcgctccccgacctcctgctgcagctctgggcccctcggccgctccctcccctcctcccttgctcaccccacggttggccgcggatctccagcacgccgccccagtcctcggcgtcccgcagcgcctgccagggtcgccgagcctcccctgcctcctggccgcctctgcagtgccgtcctcccggggctggctctctccccaggcccccgctttggccacccaggcactttccgccctgagcgtggcagctgctgccgggggtcctgggaccgcgggatgggaactcccacgcagcgtcccacaggctcctggccgccgcgagcccgcgcgactcgcacgagcatgtccacccgcagcgaggggccggtcactgctacggagcccgccagaaggcaaagccccagacagcaaatagggaggcggctggcacccagggaggccgaggcgggaggatcgctggagcccaggagttcgagacctgccttggcaacatagtaagacgcccccccaccccccgcccaccatctctacaataaatttaagaattagcctggcatagtggcgcgcgcctgtggtcccagcacttcggggaggctgaggtgggaagatcacctgcgcccaggacggtcgaggctgcagtaagccgagatcgcgccactgcactccagcctgggcgacagagcccagaccccgtaacaaagcaaaaatgaaggaggcggcggtttacttctggaataactgcagaagatcatcaagtgcagggagctgtggaactcccgggcgcccagccctcggcgcccctgcaccctcagccgtagagctggggtgttccggcccggagggataggggtttgcagggtgcgtgagcgccgaggctgcccgcgaggcgagagaattgcggggggaggcagggaggccgacggggagggcctgggaggctgcacgcgcagcggggacccggctttgtcccgagcagtttccaggtaagagctgagaggaggggagggagggagaggaggagaaccaggcccggattttcccgcctggggtcaaaccaaagcaaacaaaccaaagtggtgtgtccaaagtgatgcgcctcacaggtgccttgcttctgcccctgccggagttgaggtttggaggaagggcactgtgctgagtcccagcgggggttttgtaaatgctgcggtattggtctctcacggttcacggagcaatcaccacacttgcttgacctcctggaaagccttactctctttttataattaaaaacaattttttttggccgggtgcggtggctcatgcctgtaatcccagcactttgggaggcccaggccggcggatcacctgaggtcgggagtcggagaccagcctgaccgacgtggagaaaccccatctctactaaaaatacaaaattagccgggcgtggtggtgcatgcctgtaatcctagctactcaggaggctgaggcagaagaattgcttgaacccaggaggcggaggttgcaagtgagccaagattgcgccattgcactccagcctgggcaacaagagcgaaactcttgtctcaaaaaaaaaaaagaaaaaatttttttttagcgacaggggtctcactatgtaggccaggctagtctcaaactcctgggctcaagtgttcctccagccttggcctcccaaaatgttgggattacagacatgagtcaccgagcccagccagccttactgttcagaatgatgtcacatctttgtggactgttgaaaataaggttgtcttcctcagtctcctagaagccccaaaatagccatgcagatgtccaagcagttctggtttgattatcaaggagcatgtgtaaaatagctacgtgtgaatggggtctctgcaaatggaaactggcgggggaggctcaggactcttaagaggtctgcaggagaaagtgcataatgaacacacacccatggcctctccccatgtgccagggcatcctcccacacaggccgaaagtgctctgcagaacaaagtgcttttggtccacaaaacgcctcccagctcttgcctgcaaagggaagaaaggatagctgagaatcatgaagcagaatgccgggagatttatggaaaccccctctgatagctcaatctaattgcagctccctccagcgtgccaaatgctgctaatggacagccgctcctgccgctctgatgttgctagacctcctcagcactcagcccaaggcagccaggaagaatgaacgaatggtgattcagagggaaaggaggaagctgcgtggcatttcagagatacttattttaaaactgctggtggccatgtcttcttttcatatcagagctaatgagttttgatatgtgaacatttcttctccttcataggtaatgtgttgatttggcactttaatcttagaataatcatttctaaaaccaacccaactgcttttctttacaattttggccttagcaaacagatgagtccgttgacttgagcattgcttgggcactgtctgtgtgcaggtcaggcaggggatgctggtggctgggaaacatagaggatggaggtgtcttgggtgtacatgaaggggtggggtcaagtccacagggggtcggcccctggcagcagtcctggagggcttcgtggaggaagggagaattgagtgagaaagtggtccccaggtaagagggaagagcatccagggagaggagactgcttctgggaagaccagaggcatcacctcgcaggggctggtatggtggtggctcaggtgggaggaagagagacctcagggaaaataacaggttccattgacaggaggcctgctctggtggggaggcaggctggtggtggagtcatggctgcaggccagggagatgcctgaccaacaggtgtgttggccagggtccctgtagcaaaaacacggagctgaggacctcatggcagggaccccatgcagagggagccgcgggtggcatggggatagtcacctggctctcctgctctcggcctcctgcagctcccctcactccctgccctgccacacaaggtcaaacccaccaggaggcagaaggcgaagggcgaggtcccagggtgaggagcagggaggagatggtggcagcagggaaggtgatgcctgctgcagagtgagacctgggactgccaaacacacagtgacgggagctgaggaggcctgccgggggaggaagacagtggctggcagtgacaggaagggagggtcagcatggggcggcagtcccagagctcagggctccctgccaggccagcctttgtggcctgtggggtggaggtggcaattgctgtcatgtcataaacacgtcaagcttacaatgaaatctccagtgtggcttgggagcaaatacatgtgcaggtgtttgagtatctgtgctcttacctaacctcagggagcaggaaaacgaaagcttatcatgtaaacacatcagcagcagggcttatgtgtgtctccacactggaacccccaagacaagagactggaggcagagttgatttccaagcccagagtgctgggcagcctttgggttttatgtctgcttgcttggagctcagtgatagaaatctaggccccagaagaggaaaggactgtcctgcataaccagcacacccggggaatgcttcaggtgcagctggatccaggcatcctcaaatagtgtgattaggactccactttcctttgtcaccttggcttggctcttccctgctctgtgttgttttcagacgaggtggggccccagcagctctggtcctcctgacatcctagagaagagccagcccttccctcctggggtctacaccgtcccctaagggacctcagactgggctgatggaaggtctcaagcaggccatgtgaagggcactgcacaggaaacacagaaacgggaatcctataaggtcagcagagctctgagccctttgttcttgggcctgtttttatgatcctccctctacatgtagctcacacttccctgcttctgtgcaggcaccaggtgagggggttgtcatggcctcctgccactcttgaggctgtcagatattacctgtgctgtccctgcattctcaagctccaaattgtcaactaagaaatggtcacttaaaaagagaaaagtgaggccgggcacgctggctcatgcctgtaatcccagcactttgggaggccaaggcaggcggatcacctgaggtcaggagttggagaccagcctggccaacatggtgaaaccgtgtctccactaaaaatacaaaaatcatccaggagtggtggcgggcacgtgtaatcccaacttacttgggaggctgaggcaggagaattgcttgaacctaggaggcagaggttgcagtgagtcaagatcataccactgtactccagccatggcgacagagcaagactccgtctcaaaaaaaaaaaaggatttctgaaatggacgaagtttttttccactggcggtgccatcagtgatcgtgtctgttccactgtgaagtcggtcgtgagctctgtgacgtttccctctcaactcaaggcttttttcttccgcttatgggtgtagtccaaatggttgggatgaaaatcgtttcacagataaagaaatctacaagcccaatcgtggtgtaagaaaaaaactttaaaactctgtcgttcagaaggaaatcaggaataagaatttctcctttgagactaaaagaaagtcagctttagccagtgcattggggtgctggctcgatgtggtaaacaaagcaaaacattgtttttaaatatccaaaacattatttttaaatataaagaaatacatttttctcctctcaacaatgaagtcatagtttttttggggggcggggggtgggtgggtgggtgcacaggatttactgttttgtttgtttttttaacccaaagagaaggaaaatactttccttactcctgaaaatggtgagtttgtacattgtccttttatatggatcaatgtcatttaagcaactacagacagataagtgaagatgaatctcatccatcagaggctgggctatcaggcaccaggaccaggggcttttcttttaataagggaaacctctgctatctttggattcctcaaagcctggaatctagagctggatgacaggcttgctttggagagaatttcttgagacaacttcaaagtggcaggttttgttgaagaaaaagctcttcatggggtagttgggaacatggttagtccctctgtggggaccaggaggagcggagaggggaaagggagggagagggagagaacaaactctctgctgtcactctaagagcgccaatcccatcatgggccagaccctcatcgccttatgaagcctgatcacttcccaaaggccccgcctcctggtactatcactcagcagtccccaaccttttttggcaccaggaactggttttgtggaagacaatttttccatggactgggttgcagggatggtttcgggatgattcaagcgcattacatttattgtgcactttattattattacactctaacgtataatgaaataattatacagctcaccataatgtagaatcagtgggagccctgaacttgttttcctgcaactagacggtcccatctggtggtgatggaagacgatgacacccgaagtgtgttgctaatgtccagtctgctctgtaatctcgttttggtcgatgatattgcagaaaactctgcttcacaaacacaggatattggaaatggaagtgggcttttcagtgctttgggaacaatcacaggagattctgccttggctgtaatccagaacgtatggagatttgaagttgtcgcaaacatactttgaaggccaccagatgcagctgtacaattgaagtccatcagctcacttgcctcaataaagcctgccactgcatgcagcttgtcacttgccactcacagatagggttttgatatgactctgcaagcaattgatttatgatggtctctgtgctgtcaaacctctctgctaatgttcatctgtatttgcagccactcccaagtgctagcatcgccgcctcagctccacttcaggtcatcaggcattagttagattctcataaggagtgtgcaacccagattcctcacatgcgcagttcacaatagagtgcgctgctatgagaactaatgccactgctgatctgacaggaggcagagctcaggcggtcatgctcacccacccacctgctgctcccctcctgctgtgcggcccagttactaacagtccatggacaggtactggtccgtggcccagggactgggggccccttctgtcacccaaccaaactgggtccacttgccctcaaggaacggaagccaaacaccgaagcaccaagtttttgcaataggaaggctttattgccagttgagtgacatggagaccggaggaaatgttcctatctgtcttcccactggccttgccaccatagatgtaagagacagattttgagggtggggtttcggggcgggacgaagattggctggaaggaaggggctttgttgagtccctcggtcactcactgtcgccctacctgctgcttcatgggttgcatgtttaaaaacaatgttggcattagcatgacctggaagtggggttttgggccctctgacatcaaaaggtggctcgtgggtgagtcagtgcactctgcagactctagtcagccatgttggctccaactggtccctcctggcagcccacttagttgcaaatagaggggattgtagcaaattgtcgtcttctccactgtcctgcaaaatgagctcaagaaattttgctggttaacaaatcctgtctaatcctagggcaggtttcagtaccatcctgttagggattggggcttcaacatatgaatttggggggtacacttcagcccatggcaagctggatacttgtgctcccttcatcaagatgagaatgtgaacacacagaggcaaagcggcccatacgaggtcacagtgagagagggtgccgtggagtcagaacgcacagcagggacccagcccctaggttccgtctctgagccccaggtcccatgctgagctgcaggagtcactgtgtgcctctgctttgtgctttgtgaccacacgtcatggccaggctggggttttccaccctttgtgcgttattcccatcttagtttgaggtcagaggcctgcaggacttatttcctggtccccacgggatgaaggaggaaacccgtgggaactagcacatggccctaaaagcaacctctccttgccctcattgtccattagcacaagacactcccatcagcaccatgacagtttacaaatgctgtggaagttgctgccttttccttagagatttccaaataacctgcccctaatgtgcatgtcattagaagtcagtataagtggctgtgagtgcagctgcctcagcccatatgctgctgactccgggtgcactgctgaggagtcagccctggcccagttcaggaaaagtggctgcataatgccaccagctggcccttgcattctttcctgggtgaagccaagaaccctcaggggctaagccccactgtgagagctcacctgccacctgcatccagtgaatagggcgccatttccaggtttccccccagtgctgcagcaaacatccctgtaggccgcaactcacacgcttgcttgcatttttttttttttctgtgagataaatcttcagcagcaggattgctgagctgggtctaaaggctttcaaagttttattttcaattttttttttctcaattgtctgtaagagggcagaaccactttactctcttccagtggcagatgagaatgtgcttcttaacacctgcccagccccagggattatccctcattttagtcttggccaatctgagacaatccatgaagggaactgatgactcgctgtcttccagacatttcttcggtggtggtgaagttgagtatgtctttatgcttattggccattgttcttccaggaactgtcagttactgagctctgaccttagatttgtcatcttctaaaaactgatctgcaagagctctttgtatcttaagagaactacttttactattaatgcgtgacaaaatattctccccattgacttgatgtgctatccataagtatagtcatgaaccacataaccacattttggtcaacaacagatcgtatataacagtggtcccataaaattataatatcacatttttactgtaccttttctatgtttacatgcacaaatactcatggctgtgttacagctgcctactgtatccagcacagtgccatgctgtacacgtatgtagcctaggagctgcaggctacaccatatagcctaggtgtgtcggaggctggaccatctaggcttgtgtaagtgccctctgtgatgttctcataacaatgaaatcatctaacaacgcatttcttcgactgtgtccctgttgttaagtgaaacatgactattgctttttgtttaaagtcagtaaagaggcacagtttacactttacttacccatatatatgtatgggtgtatatatgtatgtattttttgcgacagggtcttgctctgtcacccaggctggagtacagtggcatgatcttgggtcactccagcatccacctccctggctcaagcgatccttccacctcagcctcctgagtggatggaaccacaggcgtgcactgccgtgcctactttttaaaaaattttttgtagagacagggtcttgccatgttgcccaggctggtctccaacttctagactcaagcaatctgctcacctcagcttaccaatgtgctgagattacaggcatgagccactgcacctggcctatgtgtatttatttttattgtcatatttatctgtttttttttcatgacttgtgattttgtggcatgtttagaaaggcttttcttgtttcaggattataaaaatagtcacctatactctcctctagcatttttattatttcacttttcagatttaaatttttgtttcatccagaattaattttggtcaaagagttcaatagggctacaatttatttttccctgaagaggcgggacagctgtcccaatataattcactaaagagcccatctttcctctgccaatctgcaatgccaactttactacaatgtctgcaacttaatctcaaatggtagagcaacaaacatatttagagtgtgtgtgtgttgaaattaaatcaaatgtggagaaatgttagcatagcaattattgaatcaagatagtacatttggccttcattacccacgggttctgtatctatctgcccattcaaccaactgcagattgaaaatactctggaaaaaaattttttaaatacaataataaaaaataatgcaaataaaaaccaatataacaactatttcatagcatttacatggtattagatattacaagaaaactagaaatgatttaaagtatataggatggtgcgtggaggttacatgcaaatactgtaccattttatcaaggatttgagtcttttcagattttgttatctttgggggtcccggagccaatcccctacaaatactgcgggacgattgtatgtagaagatcattacaccatccagtttccagttttgttttcacagtaaaattgtgtttaggccaggcgcggtggctgacgcctgtaatcccagcactctgggaggccgaatcacctgaggtcaggagttcgacaacagcctggccaacatggtgaaactccgtctctactaaaaatacaaaaaaaaaaaaaaaattagccggatgtggtggcacatgcctgtagtcccagctacttgggaggctgagacaagagaatcacttgaatccgggaggcggggggttggcagtgagccaagatcgcactgttgcactccagcctgggcaacagagcgagactctgtctctattaaaaaaaaaaatgtgtttaaaagtctaaaagaaaaggagcgttagaatggagatagagtctccactttcaaaatggatggttgagcaaaagttcctttcctgcagaaaaggcctggacgggtgtggccaggacgagctgagacccgatgagaaaggcagaagggcgtcaggcagggcttgcactgcaggaagctgctctggctgtccctgagtagagaagagagttgtgatgtgtggacaacaacaagacaacaagagctgttgggggcctccagctccagcttgaatgactgtttctattgatgtggagcagaaacctgtgggagccgctggcccctgtggacaagggcggtgaatgggccggcgggagcgggcagctgacttatggcgaggtggtgggtctggggtaggctgcggccttagggttggtggtgaccgtgtaccaaggcacacggctggcttccctctcacctgcaatagctgggccacggctcactgcccttcttcctcctgtcacaccagtcacactgagagagggccctgcacgtggtgacagcatgggctgaaccggttccatttgcccaagcaccagggacactcctttacctcctcaggaaggctcagctgtagaggaacagaaggaagatccgaagataataagaaggaggaaaagttggaagaagggcaggagtgcagagtgggccctccagggagggagggggcgagcgagcagccagccctgcccgaatcccccacccacaccctggccccgtcccagcagaactggtgacacttttcttcccagtgcctttcaaatttccagagcagctcagaattgctcagtagataacaggtttggggtttttatccttttcttcctaatgaccaggctcctgagaacaggagcagctgccatctgtagggtattcatcatcctcctgcaacggggaaatgagtcattttagcataaaatgtagaactgccatgaaattcaaattgcagtactttgacaagaattataatgtttgcagaaagtctcatctaggaggctgaagtggtcctgcgggaagcccccccagtcacctgagagaaacagctgcagtcgccagcaggatctgaccacctcgcccagggtggacaggactgaggccacctcttaatttttccaccctttttgttcctggacattaaataagacagagaaagcaggaaggtggggagagagcacccctgcaaataagagtcatcatccaagagagtatcaaccaagtaggcagaattcttgccaatttagttgactatgcatgggaagggaagtttctagggccttctggaaacagaatattttcttaaaggggccaccaatgataccctttggtcattccaaaatgacctctctgggcctgacgcccctgtgagacgtgaagccagctggacttcctgggtcgagtggggacttggagaacttttctgtcttataagaggattgtaagactcaccaatcagcactctgtagctaggattgtaaaacacaccaatcacctctctgtagctagcaagaggattacaaaatgcaccaatcagtgctctgtaaaatgcaccaatcagcactctgtaaaatgcagcaatcagtgctctgtaaaatgcaccaatcagcaggatcccaaaagtagccaatcgcagggaggattgaaaaaagggcactctgataggacagaaacagaacatgggaggggacaaataagggaataaaagctggcccggtcttcagcacttagccagccagcagcagcaacctgtagggttcttttctatactttggaagcttatttttttgctcttcacaataaatctttctactggtccctgtttgggtctgtgccacctttaagagctgtaatactcaccgggaaggtccacggcttcatttttggtcagcgaaacgaagaacccaatggcagcaatcaactccagacacatctggtcagtcttgttctagatccagggaaagcaatgccctaacggcaggagggaataacccttccagctgatagcagttgttcaaatagtagcaaaggcacataggaagtgtgttgccaagctgcagtctgacaattgctccaaacacgaattttgcttctaagaccctgtaagctgtgggttgtactcaaaagctgtaagttctttgtgcaaaggctggagaaggcagcgagcgggccacgtacctgtcttttcgcagagtgtgagaaacgagactgttctctttacgtggcaggacagttcagagtctctatacccagagcaaccagaacgagctccccttggagtcatggacccagtatctcagttgagcaaatggtaattttcaccaaggctggctggcattgggtgactttagtggcctgtgcacacgagcgccccaggcccttgggcagctgccagtgtgggctggggcttccttgtcgggagggagccaccctgcacctgtgggtgagttttgtctcctggcagcctggcaggcaggtgtggctcatggcagggtgagccactggcacggatctgctgctttccccaggtgagagtttctatgtgcccaaaggtcaccagaaactgacagccagccctgagcaaaccccagcccagggttcatgttgcccgagcagaacctgctggtgtggtctgcaggcgggggcgtttttcttggttggctaacactccttggaaggaggcatgggccaggccagtgtgcttagcagtaccccagagcagtgttgggggcgggagctcaagtgtggggtcagtgtgctcgcaccagagccaaacccaacacttcctgtctcttcctttcctgctgtcaggtggggctgttgttggggaaagaaaagcagggaggacagcgtgggaggctttctcagggccagccctgggaatggggcacagtgagggggtggcatgggtcacctggccccactaagggccagaggcgaggagagatgtccggctgggacttcctgggaggaaggggcgcgctgccacgcagtgcccgaggcccttgggtatctgcgagcatgggctggggcttccctgttgggagggagccacgctgcacctatgggtgagtcctgtcccctcgcagcctggcaggtaggtgtgccttgggaggaaggcacgccctgccacgcggtgtcgctactggctggcaactgttggagaatttattgaagcacgtgaaagagccccaccctgccatagcaatcacctgcctttggtgaggctgagcctggccgcgggaccccattgaccgctcctggcctcacactaaatggagttgcattgctcctccaaattccaaccaagaggaccgagaagttggcctgaagcaggcgcacacgtggaaaagaggagctgaagccacgcgggggctgctcctgcagaggaggtggcttggtctaacttttcaaagcaatggccactcggctgcatcaacctgcatgccacgttcctggctttgatcattgacatgtgcctggctctgctgctctcagctcctggcctcaaacttccttttgaagaaaatcgctgaagcttgtggcctcacttcttccaagaggcagctacagacactctccgggcctggctgcctgtttgttgggacggggcctctggcttgggtttgctgtgcttcaacgccatgtgactccgaagggcctcactcacgccagggcccagcaccggctcggggacaggccaggctggcatgactctgattctgcagatagcatttttagtgactctgctgggaattggttcctgagataacaaagccactgacacagggatgacagatggttaacagcacctcccgagagtaggtctgttctaaacacttgacctgtgacagagcatccatgccacgcggctgctccatgaagtagacgccatcatcgtggtctctgcaggtctacgatggggacactggggagagaggagtgactgtgctggagcatgcgtggatgaggggagggggaagggagggcgtgagcccggtggtccagcaccgtattgtcctgctccactttcctccgaggcttgggtgtgcacgcgctggagccctccctctctgggttggtcatggccctgtcctgtgagaggtggtgtgtggatacctcctgctcctgagtgagcccggcgctccgtaaggagtcagggaatggatccgccatgccagcccagccctgtgctgccaggagcctgtctttctagaaggtgggagtgcgggcacaggctgcctgcccagctgcagagttccctcctcaagtgcaccctggagtggggacggaggagcctagggcactcatgggctccaggttccctggctccctgccaccctcatggtgatctgtccttgcatctactggggtactcaagtaccccgggaggccttggagtatttccacctatttttccttcatggcctcccagtgtatgcttggggaaactgaggctggtaaggctgtagaacacatcacccacagcaagggccagaggggtacatgaccaggggaagaccaggcccttcagggctcatggccccagcccatggccacagagacagagagttttcacttgggtggacactgatgggtcctgctcccactgtgagaccgcgtccccctgccagctccacctggggcctaccctgggactgggaagttgtgttttaagtcttgccctgcctcagtgttccctaaggaatcctgcctggttatgacatgaagcacacgtgtggtgtcccttttgtgcttctggagctgttgccctgattggcatcttgagaagagtactggcagtcaggggatcctggtgcctgccctggctctgcccacctctgtgtgtgtgtcagccaatgggactctctgtgtctcagtttctcgtctttatttatttattttttgagacagggtctcactctgttgcccaggctggagtgcagtggcacgatcacggctcactacagcctcgacctgctgggctcaatcgatcatcctgcctcagcctcctgagtagctgggactacgggtatgtgccaccacacctggctaattaaaaattttttgggggagagccaggcatggtggctcacacctgtaatcctagcgctttgggaggctgaggcagttggatcacttgaggtcaggagttcaaaagcagcctggccaacatggtgaaacctcgcctctactaaaaatatttaaaaaattagctgggcgtggtggtgggtgcctgtaatcccagctacttgggaggctgaggcaggagaatcgcttgaaccttggaggcagaggttgcagtgaaccgagatggtgccattgcacttcagcctgggcaacaagatcgaaacttcatctaaaaaaaaatttttttttttttgagacagggtctatgttgtgcaagctggtcttgaacccctgggctcaagcaatcctcctgccttggcctcccagaagtttctcatttttaaatggaccctgacactggactgagatctcaagctggtatcccaagaactgaaccccataggaacctgcctttctgaaggaagttagagaaaggtgcttccccaggacatttggccctacctcttcctgtggtttgcagcccctggcacccacacacagcctggaaagaccccacattccctgctgagggtcgtactgtgtgctgactgtgcagaccattggaacttgtccttccctaggtaggtcagggtcctgtcaccacgttgtctggaggatagcaggtgctcctgaagtgtttctgaattggaccatatgcaaaatgtacatcaaacgagtcttaataacctattgctcctagagtaattgaattcaccactgttgaaaccccgactggcctgagaaattggctcaggtgaaggagactgaagacatgtggcacgtgcaggcaacatgggccctgcgctgggtctcactgaggggaagtgctctacagggtgtcagtgggtcaaatgtctaactggaatatgggtaggagaccagatgcatgcatgcatgttacatctcctaaggctggagttggaacggcagagtaaagagtttggcaaatcctctccctaaaaggtaacagcaaaactggataaaatggtcaaaaccatcattccaggactggaaaacagccaaaagcagacagcatgttgagacatgtttacttaaggaaaaaacccctgcatgagaaatggcatttttgcctgggcttctcatagccccacttcccacctcagttgtgtaaatctgctaggcagggcatgccatggagcccagcagctttactgccctgtggggctggctggatttgaagcaggaatagtggcaatcttgggaaaggtcaatattgtagctagcctgatgtggtaatctgagttgggcaaacatcggaccagtagactagccagaaatctgggagatttggagaatgagaaccatagtgggccttgataagtgcccacatgtccatggcagtctggaagaccaggtgcatgtgcagggctgtgcacaatacccaggagagactgcacagtccccgctatccattgagtcagccttgcatttgcagattcaaccaaccatggattgaaaatattaaaaaatggccaggggaggtggctcacacctgtagtctctgcactttgggaggtcaagatgagcagatcacttgagcccaggagttcaaaaccaggctggccaacatggtgaaaccctgtttctacatgaaatataaaaatcagctgggcgtgatggcaggcgcctgtagtcccagctgctagggaggctgaggcaggagaatcgcttgagcctgggatggggaggttgcagtgagccgagatggtgccactgcactccagcctgggtgacagagtgagactctgcctcaaaaatcaatgaaaaataataatacatggggtagtgggggagcatggaaaatgggaaagattaatgggtacaaaaatatagttagatacaacgaataagatctagtatttgatagcacaacagggtgactatagccagcaataattagttgtacattttagaataactgagggagcataattggaatgtttacaacatgaggaaacaatgaatgcttgaggtgatggatatcccatttaccctgatgtgattattagattgcatgcctgtatcaaaatatctcatgtactccataaatatgtacacctcagtacccataaaaatgaaaatacaaatacacaatacagtgtaacaactatttatatagcatttacattgtattaggtatgataagtaacacagtgatgatttaaagtctgtgagaggactgcacaagttatatacaaatactattctattttatgtaaggaaattgagcatctgtgagttttaatatctgtgggatcaaattctgggtcctggaacaaatcccctgttgatgccgggggttgactatatatctctggctgaacatgaggccttgtgcctgtgcagaggagatgtgaaacctgacagactgtgaaagctggggcacatttgtaacactgcctcaactccaaatgcattccctaaaccacacacaaatccactggcgaagcgtggaagccttagtggttaaaggtgtttaagtacatttgaccaatcattggctgaccacatatgctaacccacaggcaaccactagaggaagctagagttgaaaataacaacaacaacaacaataataaaaaccccaaactgaacagatacatcagtggctgcacactgaggttgagactgattctacaggatttgttcagtgaagtcactaaaacaaaaatacagcaacagtcccttgggggtaaggggaaggagcagaatccagagttgctacaatattacataaagtgtccagttttaaaaattatgagacatgcaaagaaacaggaaagtgtgatccctatttgggtggtaagtcgggaggaagctgggaggaagctatcaatagacactgtctgatggggcccagatgtttgaatttagtagacaaagatttcaaagcagctatgataaaatgtttaaagacctaaaagaaaccgtttcttttaatttgatgtgacttttttttttttcttggagtgacacagtctcactctgtcacccaggctagagtgcagtggcacgatctcggctcactgcaacctctgcctcctggattcaagcgattctcgtgcctcagcctccggagtagatgggactacaggcacatgccaccacatcaggctatttttttgtatttgtactagatacagggtttcaccatgttggtcaggctgatctcgaacaagtgagaggtgattcgcccgcctcagcctcccaaagtcctgggattacaggcatgagccactgcgcccagcccatttttaagagcaatgactcatcaaatacagactatcaataaaaagataggtattgtaaaaaaaaaaaaaaatcaaatggaaattctggggttgaaaagtacaataactgaaatatttagggtttaatagcagatttgatttggcaggagaaagaatcagtgaacttgaaaggagattaataaaacccatccaaattgaagaatagaaagaaaagaaaatgaagaaaaataaactgaaaaacagacctaaatttgggactcatcacgcataccaaatacatgtcatagaagtcccagaaggaaaagagagaaaagggaagaaatatttgaacaaataatagcaagaaagtcccaaatttgatgaaaaatacaccagtgaagcacaacaaacttcaaataggattaacagaaagagatctatagctagatgcatacagagttgaaggacaaagataaaatttcaaaacagcaaagaaaaaaaaaaaaaacccacaaccttatcacatacaagggaagaactacgtttaacagctgtctcaagtgaagaagacattaaaatgacatattcaaagtgctgtaggaaaaatatttattaaccaagaattctttagctagcaaaactatccttcaaaagtgaagacaaaataaacaaaaattgaagaaattcaatacaagcagatctgtcttataaaacatactaaaggaattccttcaggctgaaaagaaatgacaccagaagataacctgcatttaaccccagcatagtagaaaatacctatatttcttatatgctgtatatagatattttctagtatgcttttaattccttttttattgcttcattcttacttttttgttggaattggttgctctaggaataaagagagcaataaaggagaaagaagaacaaaaaagcctaagtcatataatctttaaataaatagagaagtggcaggaagaaattaaaccataacaatagttagattaaatgtaaatgggattaaacactccaatcaaaaggcagaaattgatagtaataaaacaagatccaactacatgttttgtataaagagacaccatttagattaaaagacacaaataccttaaaactaagtaagaatgaaaaaagatataccatacaaacagggaccataagaaaatttaactgatattctaatatcagttaaaatagactttaagacagataatattgctagaaacaaagagggatatttcataatggtcaaaaggaagatatagcaaatataaacatacatgtttctaacaacagagctccaaaatatgtaaaacccaactgacagaattgaagggagaaaaaggcaatgcaataatagttggagccttcaataccccactctcagtaactgagataactagacagaaaacaagcaaggatacagaagacctgaagaacagcagcaaccaacttgacttctcctctatctataaaaaaccccacccaacaacagaatacacattctcttcaagagcacatgcagcattctccagatagaccttgtactcgaccacaaaaaaggcctcaatgaagaggattcaaataacacaaagtatgttttcacatcagaataaaattaattaaaaacaacagaaagatatttgggaaagccccaaatatttgaaaattttaaaaattacttctaaataactcaggggttaaatcacaaggaaaatagaaaatattttgaactaaatgaaaatgtaaaaatatcaacatttatgaagtacagctaaacagtatctagagggaatttatagctttaaaatgcctattttaaaaatatctgaaatcactaaacccagcttcctccttcaaaaattagaaaaagaactgaacccaaagcaagtagaaggaaagaaataataaagactagcgcaaactccacgcaatgaaaaacagagagccaatagaagaaaatagatgaagccaaagtcaattcttgtaatgctttctgaggttaagtgtagtgtagttatataagagaagactcttgttcttaggtaatatgcatcatgtcttcaaccttatgctcgaatgattcagaagaatattgttatgggcagaaatgtttatatcccttaaaattcgtaacccccactgtggatgcatttggacatggggtctctaaggaagtaactgaggttgaatgaggtcctaagggtgggcactgatctgacaggattaggatcctcatgagacaccagagggcgtgtctgctctctccatgtgcatgtatcaaggacagcccactgaggacacagagatggtggctgtttacaagtcaggaagagaacccttaatagaaactgaccatgctggcaccttctagcctccaaaacgatgagaaaataaataaatgacagcacaaactgcaaattttccaaggaagcatcttggacctgatctaagccactcagtttaagccactcagtctgtggtattttgttaccgtagccccagctgactacatacctacctacctagagtgcactgcacaggtggaaaattggcaacactcagggagtctaggtcaagggcagaagggaagttctctgtattattctcgcaaatgctgtgttgttgcaactgagcgtgaaaatatgctaaaaaaaaataaaaactaacctttcccctgcctgggtggtggacacttaagttgctgggctgtgatgggctggaggctgtgctctcctggttccctgactgaggtgagggccttcggtttagtcctgccctccctgcacagggttctttttgcctctatcccactaagtcgtcaagacggtggacgcagatccactttctgcttcctcctggtgcctgccctgtgtttcccgtggtcctccttggaaaggccacaaaagtgtttcaagaggactcaggtccaagatgcttccttggaaaatttgcagtttgtgctgtcataaatgtggcacattaatggttgctaaaactggggagcaactcctcaaggcttggtgggagcatttcaactgagtttaaatattcaaaaacataagaaccaaatcctgtcccccaggggcagcagcactggatcctactgaccaagcttccaccctcctccctgggcctatcaagaagaaaccaatgggccggacacagtggctcatgcctgtaattaatccaggcactttgggaggccaaggtgggcggatcacttgaggccaggagtttgagaccagcctggccaacatggtgaaaccatctctactaaaaatacaaaaattagccgagcgtggtggggcagtgagccgagattgccccactgccctccagcctgggtgacagagcgagactccgtctccaggaaaaaaaaaccaatgaagccctgggactgtttggtgcatgtgtcctctactgaagagcaggctgcaaagaaactcaattttgctttaaagcactcggtttcaaatgtttctgaaagccctcagcttcccactacaacggcaaccgctgcttggtaggtatcaagactggggctgctccctgggtctcaaccttcatgctttccacttggttcctgctcatcttcaagctgtccttatccaacatggaagacactcattctcagaagtgctctgggaaaccccatgtcctcaaagtcctctctaggaaccccactgccgtcgttccagccggtttctgccacacccccactgacaagaaatgaagagttgctagggtgaatacttggcacgcccctcaacactaaacagcagcagcatactgaccacatgtcagtttccacattttctttccttctctgtttttaagggggtatgaaatgatttatacctgcatgttttcaaatccacttaagaccaggaggtgctatgtggacaaatagatcaaactacctcaaaactttacggtgacaatcaagccaaggtaaaacacgctaaaatcaccacctgtgcacccacctcttcctatttttccgcgggtgagtgccagaggagggcgttccacatgggggctctagtgcgtctcacgaggtgcacttctctcatgcaccaagtgaaaaccttacacatcttccctgcctggcattgcgccagtaggcagaaaacttggtgcaacaaaactcaatttttgtctttattggcacgtggtttcctagacaactatggacacaattccctcagaacagcctatggtgcaaagggagggaagggagagtgtcagaatgtggaaggcttgtcgtagttggttacagacctctcttctgagcaccttgtttgtgtcaacttctggctaacctgaatgaacacccatcagctgggagaaacaagcactagggggcaccttcatggtcactggtaaagaaagccctaattatctacaaaatggaaatggaaaacaaacatttaaagttttatgcattttagttttgaactagaaatcttccaagtttaatatataccttcctagtgaattcccctgccaaaaacaaacaaaaaacccctcccctaaaccaaatggtattcctgcatcttgggcaacagctccttcactgtcaagtagttccaaaggaaagcacgagtaggtaagagtcaaaaatgccactgagtttttgctgtgatcaaattgatcaggagacaacaatgtggttctgtaaaaatcagcacatcaacaatgtgtcttcccacactccatctggggaaacccggctaagcagcctggaaacagagtgccaggtcactctctacatgtagggctgctgggcagccgcagtaacgtgtgcccggatgcatctgtgtacacagctctctggtttgctttctgcaaattggacggaaaacagagcctggcttcccatccagtaaatggttttcaaactgcgagtcaagaaaaccgaaaacttactccccatctgcctgctaggtggccttcctgcatttactgccacatcccttcctagccaactgctccctgtctagacggaagccacccagtgtcaacgtctgtgtctcctcacctgagtcatctccatctgctcagtgccttgtgtactgcattaagtacttgctcagaggtcaagaggaggaactgactcacgcagcattagtggatgttcactaagccttctgttgattgtaacgttagtataggggaagggcaaaagcagaattctgaccctaaagcttggccatctgaatgaactcactgcaccatgctcagtgctgtgggaagatggttaggcaacagaaatgtccttaggaaggagctctaggtatctacacctgaccaggtgttcatgccacatactaaaaggtagggggacaaaaaacagacttactgagttgtgtccctttcacaataaattgtttccctaatttatctaaatgaaaactgtcttatttaggccttatatatgtgtgtctgtgtttacaataaggacacatttaaaacagaaaactcaacacctatatcatactacacataaagttaactcaaagtggatcacagacataaatataaaacaaaaaattctgaaacttgagaagtctttacactttgggctaagtgaagatttctcttaggatagaacatcttagtgaagatatgacaaaagcataatctatgaaagaacaaactgattaaactagacttcatcaaactgaagtcaagcgaaatgaagtaacgtttacacaaaaacctgtacgcaaatgtttatagcagtttactaataatctcccaaacctggaaacaacccagaagttccttaactggggaatggataaacaagctctggtacagccacacaatggaataccacctggcaataaaaaagaacctgcaacatcatacatgaatctcaaatgcatcatgctaagtgaaataagccagactcaaaggcaacatattgtatgattccatttatatgacactgtcaaaaaggcaactatagaaacagaagagatcatcctgccaggggctggaagaagggttgagtataaaggggtacaaatgattagagaagataaagaaactgttgtatgtattaaccgtggtaaataaacagtatgtgtttgtcaaaatttgaactatacattttaaaaacagtaacttactctatgtaaattataccttaacaaagatgaaaaaaataaaatccacatagatggattcagtccacaaaggtgtttactgaaacactatagcaataatccaaatgtcaacaggggtggcagttaagtaagtaggatgtccacaatggaatatttatgctcactaaacccattttcttcccccaaatgtgggtgacattaaacaatgcccgtgctatttatctggggaataaaaccatatacaaatggttacacgcacacacacaaacgcacgtgtgtccccatgcaggggtgtttctccacgcaggggtgtgtgtttacccacagggggaagtcggcctgctgccttctcccactctgtctccaggtccttctgccccacttcagtctgagcccttcagatgagcactgcccacccatctgtacatgctggccaaggggagaaattctgcatgcaacaccagacgacgaggtggtaggtgacgctgggtgatagggatttgtgtgcaggattttaaaacaggattataaagctgcatgaaactagaaaacagtgggcaaacagaccaagccagcactttattttaaaaagttttattttggagatttagaaatttgagatttttaataacggcaaaagaaattcagtcacacctaatgattaacagaatgtagtggtgtattatctaaacagaaatcgtgctgatgtgccataataaattgtctattagtaaaaaaatacactttagggcacagcattgtatcacaaattacagtagggatactttgcaagaatttaatcaaactagagaattctgagtaactgtatcttttaaatgcagcacttaaaaatgtaacaactctgtgcatcctttttcttaaaaaaaatgaccttgcatgtgtcatagaaacgctgctttattgctgcagaggtcaaagttcaaggctcaagaggtacaggagagaatacaaaggtagcctttagaaacgtggtcttgtttatgtataaaaaaggtaaagtttataaaagttaatttacaaaccaagaacaaaagtggtatgcacgcattatgtacaagcatccttaaaacatcaaaattttcaaatgcatagccagaaagaacagaaaaccaccactgccccttgtcaaaaaaaaaaaaaaagaaaagaaaagaaaagaaaaaaatatccccaaatcacaccactattttcttctgggtgataacacatttctgaaaccaccaaatgcacaacgtactcagtctttgtcatgatacagtatctagataatgcacaaaagccataaaaacttagtaacacaaggagaatgagctaagaattaagaacatgagggtaaggcatttctgctggttagtatgtctgtggtaatatggtgaagttagagatctgaagaggccatggaaccagtctcacatgcttttgtatccttccctaagaaaaatgtgttttcatgtacagtaagtcattgtcttcacttcaccctcccccagttgtaaatctccttgctgtacatttctgttaaatccacaacactggttatatattccaggtgcatttaaaaaatgtgtgcatattacttcatgcataataaaataaaatgtgtacgtatgctaggccagggccatagtaaagtttgaaacagtgtactttggaaagaacagacctcaaatgcacccccatttactggctggtattttaacggaaatcaatatgtgaagttaagcagtgacgataaaaaaattacaaaaatcacaaagcaaaatatctttgaacctctagccaataccaacagtcccgtcaatcacaaacatgcagtgtgtagcatgttttccgaccatggttcaggggcatgctcactcatctttatcagttcaaacaaatgcctcatactaacaaactgtagtatcaactctaaaaaaggtataatacttgatagagtggttccatttagattaagtttaatccagtttcacattatttaagttcctatatttcaagagttaaaagtggtcaataaggacagaaacacagtttgctccaacgagataatttggatctccgggaagacacttgttttgccaggttttaggatcacctatgagagaaaagaagttgatgtcatttacagttcagtaaactgctatccgtaatgctttgcaattatagggcaaatacgtatatttagacataattttcttctgtttcttcagcatattgaatttgtatcaaaacacattgctgtatttcaaagcagatctgctggcatctaacaattccaaaggtgtttcacacttctaaaaaaattttttttaaaacgttctttctaactcacaccattaagaacagttttttgttttttgtttttaattttcagacttctcctttattacattatcaagtgcattggccttttcaaaaaatgaatacaagtgagtgatggcaatcttatgcctgggacagtcccagtttgccagagcccacataattatcagtagcactttttttttttttccagtttcgaaagtctggaggataattatgtgatcacctatttgagctgagaatgaggacacatttctcacactcaactataaaccaacaaatgaagcccagttctgcagaatctagttcttgaagactgtcttcccccttacaaaaaacaagcaaaaaaacgagactgcaccagagctgctcagctctgattccagctggacaacaaaattaatcatgcagcttcaaaaactcattgactgggtgttagttaggtctcaggatttaagtttttaataagctcttggtgatttctattagatgtgaaggcagggacgactatatgtctctgtggtgtccaagcaagctgagagtcacagctgtggacgtttgcttcccttacagaagtagctctcaaacaggaatgaccctgcccctgatgggacatctggagacagttttgcttgttaccactggcatctaggggtagaggcccagggaagctgctaaatattccacgacgaacaggagggccctacaacaatcatttggccaaaatgtcaacagtgccagctgagaactttgcttacagtacgttagacattacctaagcaatatctggagccaaaagcatttcatttttccagaaaatggggtacttgtaaatatgaggaaatatgtatttacatgtaattttttcctctgataacattaaaatatgctcttgctataatctttagaccacaaacttttatttcatactgtaccaaactaaaactaaataatgctcatctgatttatcaaagatttggaagctagactttaaatcaggttcgcttaaagtgatctacacccaaaataaaattctaattattaactgacttaagtcactcaaggaagtgagaaatgtgaaaatgcagtggaagctttgaaattatctcaggagaaaaagtcatttacaaatagtgtataaaagaagtaatttagagtattacactgaaaaaccatggccaagtatgatcacaacggaagatcttgttaagtttctctggtatacatacgttgtagattaagaaattaaacaggccaggcacggtggctcacacctgtaatcccagcactctgggaggccgaggcgggtggatcactttaagtcaggagttcgaaccagcctggccaacatggtgaaaccccgtctctactaaaagtacaaaaattagccaggcatggtggtgggcacctgtaatcgaggctgaggcaggagaatcgcttgaagctgggaggcgaaggttgcagtgagctgagatcgtgccaccgcattccagcctgggcgacagagcgagactccacctcaaaaaaccaaatcaaaacaaacaaacaaaaaataaattaaacaatagtaaccaaaaatagaaatagttatataaaggaacaaagtcattttaataaggtaaaaatgcctatttgtgcaggacaatatctcccactgcatcctgaaaaatttgacagaataaatcatttttctgaacaccaagaaatagtcaatatttggccatattatcaaaaaaaaatttttttgagacggtctcgctctgttgcccaggctggagtgcagtggcacgatcttggctcactgcaatctccgcctccctggctcaagcaattctcctgcctcagcctcccgagtagctgggattacaggtgtgtgccaccacgcctggctaatttttgtatttttagtagagatggggtttcaccatgttggtcaggctggtcttgaactcctgacctcaggtaatccacttgcctcagcctcccaaagtgctgcgattacaggcatgagccacggcgcccggcccaaattatcaatttttaaaaggcagaaagtcttctacctttccatatttatttacaatatatgcaccacaaataaatgtgaaaacactggtgatgcctacaaggccacaggaacagagatagagatttgctaacacacagcatgggcagcatcatcagcccaggtattaatcaacgacagtccccaaagctcccaaaggacagagtgaagacagcatacccgacgaggagtcggatgattttagagcaaaagaccaaccgtcaggagtcatggacgcacagtgtggtaagcgcagctccacaggcttcaggaacttgaggccatggggaccacacatcaccaaaggactcagcagtgtttcacctggagttggaaaaggggataggcagagaggatggatgtggtctttcttctagaatcccagttttcctcaccctgcttctaattatatgcttgaaagcctaatggagttagttctctacagtcgcactgaccacaaaaaaacgtaacagcagccacatatggaatcttaaatttcccagtagccacgttagaaagtaaaaagaaacaagtgatatcaaatcttacaatattttaatattttaactcaatataacgaaaacactgttatttcaacatgtaatcaatatatgaaatctttggaacttggtgtgtatttcacatttccagcatctttcaatcccaaattgtcacacttcaagtgctagctagccacgtgcaggcagtggctactgcattcaatcatatgggtctataataaaaaacatattcaaatgtgcttgttgcgaatgtgatatattttccattttcaaaatgttttgtttgctccataggtggttaaagagattcatgcagggccaacacagtcagtcctactggtttttaaaacaggatatccccaaaatcagagtacagaatcagatgtcagtattccggcaaaatacaaaaaagcgaactaaatttgtttaggaagtaaaagcactgctaaaagatgctaaatcacaacacacttcgttataatatcctggtagatccaggaggattatgaaaataagtttccttaagaagctcagaaacatgctgtcatctcctctgagactccttcatgcactctgctgagcatgtactagtgctaggttctggggtgatgaataagacagtacctgtcaagaggtttaggttctccaatcaggtgaaggcacagcaaagcctttctgagtgggtgttacctaacccatctccagagacgcaaaggctgactgattcaaagacaaatttggttaggtcagcctaggctgctcagcaggtgagacatcccgtggcctgtcctatgccatcattttttatttcacaccaaaagtaaaagcaggcagtgtggtcaccacagccttgcttcaggccacccactgcttgcttgcaacaccgtccccagggcacccctcgctacagcactcatctggagatagagaggtgctgcattattagccaagcactataagctctgaagtgcacacagggcaactcttaagttatcaaaactaaggagaaaaataaacacatttacctttctctttatctaaaggtggaaggatgctgttgtcccggcagaccttgaaatagatttcctgctcaactccttcgggaatggctccttgagggataattatactaacaccagtttctatggaactcagcacgcccccattgctgttaaatatgcctcgggctgtggccaccacagtatgaccatcttcatcttcatcctcttccacagctgaaggactgaaagttcagaaatggctagtgagtgaattcctaataatacacaggtgctttgcttttactactactgtattacgtgctttcacttttatttctccatataatcaagaagttactttaacaagataagtttctggcaacagattttactgacagggttatcgcagagaatattatttcttttttgtttgtttgtttggttttgagacagagtctcactctgtcgcccaggctggagtgcagtggcacaatcttggttcactgcaacctccatctcccaggttcaagtgatttttctgcctcagcctcccatgtagctgggactacaggcgcacgccaccaagcctggctaatttttgtatttttagtagagatggggtttcaccatattggccgggctggtctcaaactcctgatctcgtcgtgatccacctgccttggtctcccaaagtgctgaggttacaggcgtgagccaccgcgcctggcgagaatattatttctagagaaattccattctagaaaatttcaaaaattctagagaaatgtcaaaaattcaatttttgaaggcaattagtcaaacgaccttcattaatgaattgcaacctgaaagtgtaaaatctgatgccttgaacacccaactacaggtgaagcatccctaacctgaaaatctgaaatgctccaaaatcggaaacttttttttgagtgtcaaaatgaagctcaaaggaaatgctcattggagcattttggcaatattccaaaatccaaaaaaacccaagatatgagacacttcagaacccaagaagtttggacaagggatactaaacaggtacagagttttatgaagcacattttaaaatccatgaaattggaactttaaaactggtaagtcacaatttaattggtagccctgttcttcccttcctgttgttttttgaaatggagtgtcttgctgtcacccaggctagagtacagcggtgcaatcttggctcactgcaacctccacctcccaggttcaagcaattttcctgcctcagcttctgagtagctaggattacaggcgtctgccaccatgcccggctaatttttgtatttttagtagacatgggttttcaccgtgttggccaggatggaactcctgacttccagtgatccgcccgcctcaacctccgaaagtgctgggattagaggcatgagccaccgtgcctggctgttcttccatttttagtgacacaaaacaatggtgcatctcacggctgacagcatctcagacttgataaaatctccctaggattttaagtgtgcctgagtatggtcctgcctcagcattccctgaggaccaagcgcccgctctggctgtaggaggcaaggcttccaaggttccatgaggcgaagacccttgtatgggcatatcccaaacatccacgaaagagagacagtagattaacttagtaatcacagaacgccaaaggcaaaggggatgtggtatcaatgactgcttcaaaagtagaggctatcaacttcctgaaagtacagttttgagccagggctcaaaggtgagcagaaagaccaacgaaacagaattacatgaaggtagctgccgtttcactccagcatgaccggagtgccagggacgacatcctacgacacaacatcaagggagcagagcgcagcctgagctgcagagcagaggccagctctgtccgcccctgaccatctgtggatgtgcagagctaggaaggcagtgaccgccataaccatcctttctcttggaaagcagactcaggtggccatcctgacctttggttctccctgcctgcaagtgcttctgctttatggtggcgtgaaaatggaactggctgtaggaggctgagatgagcttttatgtatggccagaatccatctggtcaatcgccgtggaatgaaagacaggaaagaggagctgcagggaggctccaggtgggctcactttgtctcatttgctcagccatctcactaactgctgctctttaaacagtcagaggttattctatttttcttcttagcatcattgtggaacaaataatgaatgaggaacatagatacttaatgtttttagatgtcctccacatgcaccttaccagtaggtcaggaggttacaaaaggtcatggctggttaagagtatgggctcctggctgggtgcagtggctcacgcctgtaatcctaacactttgggaggtggaggcggatggatcacttgagatcagaagttcaaaaccagtctggccaacatggtgaaaacctctactaaaaatacaaaaaatttagccaggcgtggtggcacacacctgtagtcccagctacttaggaggctgaggcaggagaattgcctgaacccagggggtggaggttgcagtgaaccaagatcgcaccactgcactccagcctgggcgacagagggagactcttgtctcaaaaaaaaaaaaaaaaaaaagcatgggctcagaggtcggatgaccagcagctaaattgaggctcacctcactctagctgtgaccctgggcaaactgcttactgtcactcaacctcagttcttagtaaaacagggatgatgacaatacctaccaaccatacacgactgttagctttattattttaccaacatcttgtacctcctggaggaccttctatgtaacagcattcattgcaacaacactcttcagtttaaaggttgagttaaaaagatcactttaaagtcccaagtcaaataaactacaacaaactcacatgagaaaaatcacagggccaatgctttgagcaaaggcataagtcttacctcacaggaatagctttaggcactgtgctgatattatttatttgatatttaggcttctctgcatggatagagaaagtttcaactccactgtcaaactcaggaggctgtgccaaactgtgcgatttcacaagagtttttggagaagtgggagtttttgaagacaagtcaggtttatgtgcagtttcacttggcagaagattgtgattgaatttaggactttcaaacttgcgttcaaatggtcgggcagaacttgtatatggttttggtgtgaatcgattgtatgctggagtgactgttttctgagtctgttcagttccattaactggggctttatctggaaaacttttctggggatagaaagctgcctgagcagtatcttctcggtttggtggtctgaaagttgctggcttattctgagatggaggtgggtctggtttggacactaaggaattctgaaaatccaatgacactgaattacctgaaaaacaaacgtaagcatttaaataactttctgaaaaaagttataatagccctgtcccagcttaacttgtcctggtgctggagtcgaggcccaaatgtgggtcgcacagccagagcctgactcttgagccctggaggctaggtgtgatgctgagggatgagggcagcatggacaggtggtgccatgaatatatataccctgctgccctggagtcagggtccagctgctaagattcctggcctccaaagattggcactagtctttgtgaaaactagaatgcccaataatcatataataaggatactcactattaattagaaaaatgtaaaacaaaaccaacaaaaagcattaaatactatttcacacccactagaatggaaaaaccgaaaagtctgatgatgccaaacattggttaaaaagtggaaccacaggattttttatgcactgccagccacagtgtaacacagtaccaactgaactctgtgaaataattaaggacactacaagacaggagaattattaatccaaatacctcatgaatatagtaatataattttccacagtacgagaagaaaaatcatatggtcatcttaatacatgcaggaaaaacatctgactgctttcagcaaactctgaatatagggaatgtcttaaacatgataaaggacatctacgaaaatcctagagctaacattctaaaggataaaacatgaggtccttcctccttaaaatcaggaactagcaaaagaggtccaatttcaccacttacatttcagagtttattggaggtcctggccagtgcaatcagcaagaaaagaaagaaggctaggtgcggtggctcatgcctgtaatcccagcactcttgagaggccgaggtgggcggatcacctgaggtcaggagttcgtgaccagcctggctaacatgatgaaaccctgtctctacaaaaaatacaaaaattagccgggcgtggtggtgtgcgcctatagtcccagctactcaggaggctgaggcaggagaatcacctgaacccgagaggcagaggttgcagtgagctgagactgcgccactgcactgtagcctgggcgagagcaaggcttcgtctcaaaaagaggaaaaaaaaaaagagaaaaggcataaggactggaaagtaagaattaaaactgtctttatctgtaaacatgggcatgtgtgaaaaaaaatcttaataaaagatagcctcaatccagaactataacacatctgcttgaagactcacaagcccaaggaggtgcctcctaagggaataataagagaagtctgtgctaggaaaatgcctgtccacagcagaagagataaccactttgtgttatatgctgagggtaaaatgttacaaagctcttaagatgaataatctggagctatatgtgatctacctggtatgtaaatgcaaaagtcaaggtgtatgggatacattttatatgaaacattatggcttttctatttgggtgtgtgagataaaacatagtaggttttacaaaccatctttacatatactggcaaacactacttccagaagatttagagactagcataaaatagattaaaatctgtttagctaaaaggcttgtccaaaataatggtcttgtaaaaacaggagacatacttttaacaaaattcttagtttttactgttcccagcccaaaggtttcaagcatgtattttttaatgtaaaaaccattttgcctagaaaccaccagaattttacttcataagcattactgtgttaaaatgtctacttccgaacttcctaccttcaccatgtgctcccttagaatgtatgtggagagacgcgctggtgacaggctgagatggctgggcatactgcgagggcaatggaggaggagggggagtggcctggatgggttcatagcgtttctcgccaaatgatctatccacaccatcagcttcaggaggctttcccctgttaacaaatgaagaaaatgccaacacctgaaaatggactcacatttacaaaacaagttctcatttctccatgtatctctaagttaaaaaaaaaaactagaaatttcacaatttattctcatgagtatgggtagctactctaccaaaatataaaaacagattcgaccattcatcggcacaagaaatgtccagacacacaaaaactttaagaatattagtaaaacatccagaagatggcaaccaaaggcaggtgaaattttgggtatagtttaattgttatttacaaaagatagtaatgttgacagatttaagaaagtcttgcaaatattctgaaaacatatcatggcacaaattttcctgagacccactttttttgtttttgagacagggtctcattctgtcgcccagactggagtgcagtggcgcgatctcagtttaccacaacctctgcctcccaggctcaagtgattcttctgcctcagcctcccgagtagctgggattacagatgccagccaccacgcctggctaatttttgtacttttagtagagatggcgtttcaccacgttgtccaggctggtcttgaactcctgacctcaagtgagccgcctgcctctgcttcttaaaagtgctgggattacaggcatgagccaccgcacccggccctagacccacttctgattttgtatctggcatctggcatactcggagcaccataaaaacagatgtcacagactaggggttggcaaactttttcactgaaacaccagagagtaaatgtttgtggtcttttggcccatacagtctttgttagaactattcaaattatgcggttatagccttgaagcagccacagacaatgggcatatctgcgtttcagtaaaactaaaaaaactggagcttttactttaaaatttccccttgagttaccaggtccattttttggttaaatgactgctagagcagcagatcctgctttattttacaaggttcatttaagtcaaattgtgccatgtatgtttattttttcagattgccaattgttaatatgtaacacaaaattcacacaaatctttttaaaagacccataattgcaacattgccatctaaaccttactgctgaatgccaaagctgcactagctttatgtgcaccaacaataacatatacatttggaatactcctggtcattttcataaattttcattgaagaagtcttatgattggcttttttatcttgctttcatgaatttagactaagcccttgatgatgacattaaaatctgaaagtgcacataatgccagtgacacagtgagggacaccttatggaacagcctcacattaattgccagtcttaccacttgacgttccttttcaagtagtcatagctagtgtaagagccaagaaatctaggtgatggcaaagcaagcgcaatagaaaaatgaaagaaaatggtcaatctaactaagtaaatttgcagcaaatggaactcaaatgtcatttaaaaatatcaaccaacatccaccatttcaccataatttggtctataaaggaacatatcactaactctcatttggccaaggaaattgaagataaataaaacacaatcacttagttatgtcccgtctgctggcccatccttcatgtactttaactgttactgcagtgaaaagcaatgtgtttgaactttgctccttctccacctctgttgcagctgctaatagtgagcaaagaaatttatcaaatcaaagagtggtgatcaaggataattagcaggttctgaataagtgggagtgacatgtcccattaaaaaaaaaaaaaaaaaggctgggcaaagaaattctgcaagtgaagacacaggaaaaagtaacacaacagaagagctacattgagcccctgggaggggaatggtaaatggagagatagaaatatgcctggcttgaaacctggccaggcttcacatgttcctttctagcaagacctcctccatctccaatcgtaagctgggccctgtggtggtggagtcttactggtgaagctgcatgcttgatgctcaggctctctctcatctaatgatgtctcacaaacacaaaaacaactgaacatcagtctctcacatttagttctttaaaagctacaaaccaccatcatttattgagacctggaagtctcacatagtgagttgagtcctgaaaggtagatttgataacaaaaaatccctggttgtcctgaagaagttgactcaatctctggactgagacatgtgcacagccctggagggacactgctcttcttgcactgttttagaatcctggaaacttctaatttactttggaggtgaatgtctaagctactgtctcctaacctttccagttctaatccagctctatggaactgttagactgggtaatatctgcttgcttcctggggcatctgtcctgtgctaacaaagattattttccatatctaattctcaccatttctgaggtgtgtttttaagtgaagcataagcacacatcatctgaaggaagaaaattttgctactcctgtatttactgaaagaaagaaatgcctgaaggcagtcttatttagtgacaaacagtaaatggttttgaaatgcaggacagaatcctatattttaagctattttccagttgatgaagttgtactcattggacaagagtatgaaaaagcattacaagggaaacttacagaaacaactaccctcttagttatcttccatgacccttattctcctttccatttctctaaccattaaatacctatatgggaaaatgcagcacaattataaagagtttcaatttcacactacaaaggaaaaaaaagtatactggtatccagcccaaactatacttttctctctcacagcagcagggagtaaaatcaaactgagttctgagtaaattcacaaagacagatgtcatctgtttcacaatatatccctgtgaaaacaatgaccaggtaatacaggttccttccagagctgtgttaatgaaaagaagggtggtggatgcacctagtataccatgccctgttttgagcttcattcactcaacaattactgagcccctactgcatgcaaggcaatgttctacaccctaaagttatacatcacaaataagctaagtcttctttctagaaaaacaaattaacacagaaagcaaacatgcattttgattgattccctggcaaaacaacttactttttagacctaaatatactcctttttttttttgagatgagtctggctctgtcgcccagactggagtgcagtggcgcgatctcggctcattgcaagctccgcctcccgggttcatgccattctcctgcctcagcctccagagtagctgggactacaggcacctgccaccatgcccaggtaattttttgtatttttagtagagacagggtttcaccatattagccaggatggtctcgatctcctgacctcatgatccacccacctcggcctcccaaagtgctgggagtacaggcgtgagccactgcgcccagcctttttttttttttttttttttgagacagagtctcactctgttgcccaagctggagtccagtggcacgatctcggctcactgcaagctctgtctcccgggttcacgccattctcctgcctcagtctcccgagtagctgggactataggagcccgccaccacgccccgctgatttttttgtatttttagtagagatggggtttcatcgtgttagccaggatggtctcgatctcctgacctcatgatcagcctgccttggtctcccaaagtgctgggattacaggcacgagccactgcgcctggccatataatctttttaaggttgtattctatttaccaaatatgtaaaacgataaataagagatatctttaaactaaacacctgagccttcttctgacaggaatgaatgtgtttaacggtgtttagtaaaaataataactaaagggtacacccttctgccttaccaaaggtgagctcctatggctcagtgcctagctcactttaggctagtcaccatttagatgttactgtgataactgtgtaaatgaattcctgtaacactgtaaatgtaaatgaattcctaatgacaaatccacatctgtttttgttcttgtgggttttgttctgttgaggtatgaacccagctgtgcacctgtgtgggtttatattgtgctagctcacttcagtccagacaccatctagatgccacaacccctttctagtgttgtgctaaggggtggttcacaacactagtacaagacacgttttgcatttaatacaacccccactgcagcactctcagtttgcatttggattctcataaactgctttcttctgtaaacataaagccttaaatataggacagtgaaaaaagtcttcactacaaaggatgtcttagaaaaaagcagtggtaattaaaattaggttttaatgttagtggttttaaagtatgttctaaaacaatttacactcaatagtaaatgacaaataggtcatttcccaagataatcccaagcccacgcaactaagtaaggaaaaatctaggtgcttttaatatagacacaatactatgtgtgatgaattctaatatgtcaatctggctaggtactgccatgaagggatttttcaggtgtaatgtccccaagtcagttgaggggagatggtcttgggagggcctggcctaatcagcagagccctctgaatgagaatttaggccttccctgatctcacactccccagtagctcaaaatcttcccttcctgaccaactgccctctgaaataggacttgcttagccagcccctgtaactgtgtaaatgaatttcttttgacaaatccacatctgtttttgttcttgtgggttttgttctattgaggtatgaatctacctgtgtgcccgtgtgggcttagacacaactatcagtaccaaattctcttatcagtcagggttcaaccagagacacagaaccagtaggagacacaaacccacgcaggcacaagaaaggagaacaaaccaacacgaaacccagggatgagtaaacggaggggagcagcaagcacagggaaaagatgactgggagtcaagaaacttggggttcagtcccagctctgccctgtcattttccctcacctgtaaaactggatcagaaatcttacaaaaacaaaaaacaaaaaacctcttcagtatttccctcaaacaggatcctcctcacatctgtatttatatttaaaaaataaaaacagaaaagaaaaagaaccagcatgacatcattaggtgtgtgtacagaagtgaagactgatgattacctatcgatgagggtccttgtggttgacactgtcttccgtcaaaaccctgtgatgttagcatctttgtgaatgcaaaaactatgtacatctaatagcagactttaaaaacaaaacacacatcccagaactaaaaagtatgtacaatgctgaaccactagagcctacagaaatcatatattacacttaaattatttttcttcaaaatatattgaactgcacgggattaatatgctgcatcctatttttaaaagccaggtgaaatagcttactttgaagaataactagaaaaatttgattgattctgagaatgcgctggctttgcaggctcggagagatggctggcggcaatgtgtgcaggaggcttattctcaaaacttcttcggtcaaagtatgacagctgttttcgataatattcttcatcttcttcagggtcataatgattggaccgaacaatatcttcaggtggcttcagttgaggtttttgaggttctgggatcctaacagataatgaatgacaaacggaacacctttttaaatattaatgttatgaaggaagtagaatatgtaagtcttatcttgactaaaaggtcaataattactaactgctgtgattactgaggatctgagcagtcccaacagttaaaatggatatttcaaatcccatgtcctcacagagtatactcaaaaggcagcccccttctggctcatgagtcctttaacacaatataataagctaaacgattacatgattagggaacagcaggttagaagtagttaatcagaaagacaaagggcaatgtaaccgagacagtgaacatcttgagaagtacatataccaaggtcaagaacagtaaatgatagactttaagaactttcaaagggatttttaagaactcagtccaggatctcaatgattctcatatgaacaaataactctatatggtctaaagttctagaaggcatacaaagcagatgaggaagaaagcaagtcattaagtaaattcatattagacagttctcttctttatcctaagtgcaaacatatattcagtcaaaaaacaaaatcagaagagctgtattcaaatctaatctgtcacttattggcagtgcaatgaggccatgggaaaaagctcaggctgaggagcagcaggccaggtttctcttccagctctaagtcttgtaagctacttgcccctctcagcctcagtgtctctctctacaatgcagaacaacaacagtgtcacctcattatgctgatgtgcttagcacaagggcaagcaccttatgcatgctcactaaatgatttagttatcttaaccaatctgagtctgtttcctcaccactggaaactaagagttcacatgtcgaaaagcacttttaaaactaaaaaacataatacaaatgtcagagcttaaaaatgtttatttaatcatctgcttggagaatatctttccgaaagtctgctaaaggtataaagatttgtcagatttgtcagaaataaagttctactttttttccccctagaatcactgtttaggagagctgatagtttttatttaaggacaaactcctcctattcacacctctcctctactaacacagtaaaaggttttcttattgactaagagggttaaattcctggtcagttctatgccacaaagagcacaaagtgtactcacctgtacagagttttgtcatgttcactgaattgattctgagaagtgggtttgggaccaatgatgggagcacctgaaggtttagatgctacttctggaggctgtttaaaaaaaaaaaaaaaaaaaagacaaatatgcctaaggaacagataattaacagaatagatatcatgtaatggcggaggggagagccaagaagccttttaaacggtgtgcccatgcatccaaggcactaaagacatatttaccttaaaactgccagtgtcatttacatccttcttggtctctaaggatgcagatcttttgttttcaaacatcttaactctggtgagtacagactgtggcttcattgctggatcttcctcttcttcggtttgagttgggggtggaggcagtggtttggtgtttgaaggcagagcttctggcttatgctgagatgaaggtatcagcggagggacagctgcagcaccatggagaggctcaaaatgacctgctctagaggtaaatccttggggtggtacttgctcgtaactgcgtgaatattgctcaaaatactgcttggactctgcaggcttgggccctgctgaagggtggggctgggcttccggtctgagtctaccatgtgtgtcatacccaggagctggctgctcttcgtgccgcagggcggatgctctaggtgcctgttcgtaacgtggtctgctgtcgtaagacagaggggctggctcttcaaaacgtggaaagtaccctcgttctgaggactcttcgggatgctgtctggagtcaaggtcttgagagtgctgattatcaaaaggtggccgagatgggtagggctgtttgtcatcataatatgaccactgttcttcatacatggggacgcgatcttcgtatcgcagacgatgttcatagtttcgagaaaactggtccgtatagcttgaggactcgtatctgtatgtgggctgctcgaggtctctgctggcttgtttctctacgtatgggagttggggttcataggtcagattaggctctttgtctggcctgtgccctgggtgactaacggctggctgtttcaaaacatggttctgcctcatcatttcctcgggatatggatcctttctatacacctgtataaaaaattcacatttaaggacaaagtcttgtttctaattctagtctattttattagactgtgattaaatattaaactacgatttaatatgtgaaaatggtatgttttaccatttattatcaggatagacaagattagtggaaaaagctggtttaagtgaaagctcaaaatttataatgcaggtaggggcttttatgtttcagcatgtactaaataaacagtgagttaaagataaatattaaatttagtagaaaattaatgcactattgattacacttcattttgacactgaaaaatcctaaagaagatttatgggcatcataatttgtattaacataaatatgtttatgatgggtttcgattacatattaaggaattctggaagatactgaaagccaaaaataaaaataataagcacaaatctcaattaaaaggcctgttttcaaataatcagtataccaatggaagccatgcaaactacgaaactgaaatgatttgtattgatttgaaagcattacagtgtataagcctgcagtaaaaaagcaaaaggaacacttaaagggcaaagcaaaaatgatcatgtgccagattgatggacagcaacaaattagtgcaacaccgcagcacaggtacctttgttggatctacatgcgacgacaatgatggttcttgatctcttagcattatgtgagctgcctcagtacttggtgttcttaaagaatcagcttgtggtgagtaagaggtggaaggagctggggtgggctcctccagtctgacattagttaaatttacattatgattaacagcagaggttgatgatgctgggtttgtttcaggcgaaaggtaagggactggagatgaagcttctgctttctgtgaagtgtttaaaatattttaaatatagtgtttctgtttactgctaactttccacttcaatttatagtgattggtagacatacattttaagtgtgctgaataacaaaattatgacctcatgtcctaaactttttgggaaaaaaaaaaaatccagtacattgctgtgttaagacaaacacacaaaatttagaattaagcccttggtactctcaaattgaaattgaagattaattcttaatctggagaaaggacaacatatatatttttaactcaatcaccacattctaaaatttaataatgcacctctatctacaaaacgttgaatgcttgctgcttacctgttgagaggctggcttaaatccaggggagtctattctatgaattggttgtggctgcgcttgtggtgagtaaggaggatatgtttggttttcatgatgcattccagaggagtcctctcttacaggctcagaggaccgtgtaatggcagactccggtggagtcccaacctcatcattaagagtttcatctagttcttgatcagtgtaggccccgccttctgtgtctgtgtcttcatagtcagaagtgtgtctactgtccgtgctatacattgagtattcactacctggagctgacaggtaggacagacgatcatcatgcaaatcaaggtcatcacttgtagcaccatccgcctgggtcaaataaaagtaaattacaaattttattcagtagttctttaagagatggcctttatcgtacaaggcagattgaaaaggatatctttctctggagaagtcacatctacttcttgaaacttctggtaaggaaaagtcaagaagattgtacaagcacacacgcagacacatggagcaccccttgagatctgaagggcatggatgaaggaaacagtggccggtaagccaggacaaagttagactccagggcccagccctggaagacaacgaagaaactctgacactgctcagatttataaaacctactcactagctcttcagcccttttaagcaaggggaagagggagaatgttaccaaactaagctcacagaaacaaggacacactgacagaatagcacatggaagaatacctatgaaataaacccaacagttcaaaagttgaataagagctaatatatttatgtttaggaaacaactgatatggtttggatttgtgttcccacccaaatctcatgttgaattgtaatccccagtgttgggggaggggcctggtgggaggtgactggatcatgggggtggtttctaatggtttagcaccatctccctcacacagtcttgtgatagaattctcccaagatctgtttttttaagtgtgcagcacctccccaactctcttcctcctgctccagccatataagacatgcttccttccccttccgccacgattgtaagttgcctgaggcctccccagaagcagaagcctgtacagcctgcagaactgtgagccaatgaaaccttttctttataaattacccagtctcaggtggttctttatcacagtgtgagaatggactaatacagtaaattggtaccagagaagtagggcattgccaaaaagatacctgaaaatgtggaagcagctttggaactgggtaatgggcagaggttggaacagtttggagggctcaagagaagacagaaaaatgagggaaagtttggaatttcctagagacctgttgaatggttttgaccaaaatgctaatagtgatatggacaataaagtccaggctgtggaggtctcagacagagatgaagaacttactgggaactggagtaaaggtcattcattcttgctatgctttagcaaagacactggtggcactgtgcccctgctctagtgatctgtggaactttgaacttgagagagatgatttagggtatctggtggaagaaatttctgaatagcaaagcattcaagatgcgacctggctgcttctaacagcatgtgttcatatgtgtgcacaaacagattatctgaaactggaacttatatttaaaagtgaagcagagcataaaagtttggaaaatttgcagcctggctatgcagtaaaaaataaaaacccattttctggggaggaattcaagctggctgcagaaatttgttaagtaacgagggacagaatattaacagacaaaacaatgggggaaaatgtctccagggcattttggaggcctatgcggcagcccctcccatcacaagcctggaggcctaggagggaaaaaatggttttgtgggtgatccaggcccggccctgctgctctgtgcagcctcaggacatggtgccctgcatcatggctgttctagctccagacatggccaaaatgggccaagttacagctcaggctgttgcttcagagggtgcaagccctaagccttggcagcttccacatgatgctaagtctgcgggtgcacagagggagacagttgaggcttgggagcctctgcctagatttcagaggatgtatggaaatgcctggatgtccaggcagaagtctgctgcaggagcggagccctcatggagcacctccagggcagtgtggaggggaaatgtggggttggagccccccaccagacagtccccactggggcactgcctagtggagctgtgagaagaggcccattgtcctccagaccttagagaggtaggtccaccaacagcatgcaccatgcacctggaaaagccacaggcacacaatgccagtccatgaaaggagctgcaggggctgtgccctgcgtggctacaggggcagagctgtccaaggccttggtagctcaccccttgcatcattgtagcctgggtgtgagcagtggagtcaacggagattattttggagctttaagatttaatgactaatctacttacttttggaatttcatggggattggagctcctttgttttggcagacttctccattttgaaaagggagtatttacccaatgtttatgtcccctttgtatcttggaagtaactaacttgtttttgattttacaggctcctagacagaagagactagccttgtctcagatgagactttgaacttctgagttaatgctgaaatgagttaagactttggggcactgttgggaacgcaccatcatattttgcaatgtgagaaggacatgaaatttgggagggaccaggaacagaatgatatggtttggatttgtgtccccacccacatctcatgttgaattataatcctcagtgttggagtggggcctggtaggaggtgatcacgagggcggtttctaatggtttagcaccatccccctaatactattttgtgataagagttctcccaagctctgtctgtttaaaagtgtgtagtactccccccttctctctcttcctcctgctccaaccatgtaagacatgctttttccccttcactgtcttaagtttcctgaggcctccccagaagcaggagcctgtacagcccacagaactgtgagccaattaaatctcttttctttataagttacccggtctcaggtagttctttacagcagttcaagagcagactaaaacaacctgttaaacatttggcccttaaagctgttatgaaacacaatggaaaatcatcacctacatggtggttgctacattaagaagaaattatttattatttttcatagaaacagtatccaacagatggagaggaagaaatacagtaatgcttttcttttgttaagtaattaagaactcagtttctaatagtttatgttgattatcttctgagtagatcagaaagaaagtgagaagtatttgagggaaaggaagctacagagttgcaatcaacaggttatcactggacactaacgtgacactagtacctggatgaaaaagaacactccctgaagaccctgcctagacaccgtgctcagttactcatgagagctgaaggatctggaatccaggaatcagaaagtatttcttccacttcagtatggaatgaaggacaaacatgaaactcttgtcctccagaaagatgcactgctattaactagcaggtttggtgtggctctgcaggtctgctgtgccagaagcatggtcttgggagtcaagttgcctgaatggagctttccacgcagtccccatgcttggctcgttaagactctgaccttgagcactgccttcctgataagaaagactagggtgtgtcaggtctccccatgctccagttttcaagagagcatctgccaggctgggctggggagagtgggaatccagggatctatcctgttagagcacaatccctctgaacaagtctcaatggcttctcaactcggtaacagctgttgcagaagaaaagtcttcttgctatctactctaatctttaacttgccagggttctgaatactataatccagtagccagtcaaggaaatattgaaagtctgggcaagaataacttagaactaatcaatccacttaagtttttaaagctggtttgaaatgcagatgtaagcaagaacgatgggttgctttgaactaggaaatatgttaagaaagcctcaggatgacttttcctggtttagcagggaatatgtaagactgtgtcagatcttgtaaaaaggaactctttctagcaattaggtcaaagtagttggttcaggaaagtcaatgtgaaatgaagtagttttagtttaagaatctattctatgaaatatacttgaagagaagaggacaggaagataagctgtaagttgtaacaaccttttctggcttacaaaatgcatcagtctagcctgataataaataacctatttttcctcacataaaaagctagaaagttggacctttattttaaaaccaagcaaagaaagcacacaagactatcactaaaatactttatagaaaattaagatttgtggattttaaaaaagcctctcagatactacaaatgtatactttgtgcattttgggaaaacatttatagactactttcattttaagaattcactagtgaaagctattaacattggacctgccaaaggatgttaacagaattgtgttgctatagaaggttagtatgaagactacaatcctttcaagtgctgcaaaagtagaaattagtaatagtgtgttcatgtaaagtggtgtggtttgtttccaccttcattttcctatccagttccagctgacatgttattcagagtggtcttaggctctcgtatgcatggtccatcccccagactggttcataatgagaaaaaccatagttctgacacattactataggtgagaacaatagacactgcctctcagtgttaacagctctccttgcagaggctgtgtatgtctgggtagaggacatggggggtcctaagcatgcagcatgcactgtcagagcatctgtagccacagccaggcagaggaaggtagggaccatgcgggggcaaaacacaacaaaaaccaaaccaacaaggaagtacaaagaacaaaataaaaaccagagatactctcaatcttccctaataaccaaaacttactgcactgatctgaaaaaggtaaaagacatttaaaaaaaaaaagcttccctcaatggtgtattctgaggaaatgattaactctccagacaaaataaacagaccttcccatcaaagattgctataaaaccagaaagactgacaatagaaagtagttattttaaagctggccatttggacgtatagaaaaccaaaattcaaagccaggaaggatctattgctttgttcaatatctcccagtatgttgtgagaatgttaacaggtgttgagtgaaaaataaatgcaaggaaatgcatgaagtcggctttttaacttttaagatgtctcagagcctttaaatgccagtgggtacgaggatactcgtgaggggtctagggtttatttcccatccgctgcttgccttcatagtgccttctctcttagagcaagtcctgaattgagcatgctgaggacagcactttgggagatgctcatctaggccatccaaatcccctcattttcagaggaggaaactgaagccaggctcaaagtcatcattcatagccagacaggggcagcatcagaactcaacctgctcttcattataatttaagattctttaggagacaatcctactgcagtggtaattcaacaggtgagaaaatttaagaattctcttaccatcagaaacaactttcataacccctacacacaaattataaaaacctaaaagctaactttccccaaatttctccaatatgttgatctaattagaaagcactggtatctcaaaagcatctctgattagttacataatttactgaacaagtcaaaaaagtaataggaaatgtcttacctttccctcggaaacccataccagctggttttgctgttgttgaattgcttctttcagcgcaccataccaaccatcattcattgaatttaagttaattgtagctgaaaataaattaacgatgtagttttatggttagagcactgccaaaagtcagaattaattcaaccctgcttacagctaaatcgtcattactgaaagatggtatctgaggatgcaaacatttgaaatttctattttgctactgtatattttcttttaaccaaacagcaggtgttaacacaacaggaagctttccaagaaagtatcatgtaagttttagtatttgaacaccgtaacattttggcctacttaatgttgcccagacattgtaagctgaaagaaggcctttattaacatactcacttgtaaaaagatggtgattatttttacgaagtttatgagatcgctcgtataacttcctggcacttttccgagattctggacataacctcattctcattgtttttactccttgcttagaatcagggttaagaaatacaacaattggataccactgggcatagttaagacgatcaactgcatttggtgttacatctaataaagcatgtttgtcctagaaacagaaagaaaaatatatacaaagacacaagacatcattaattaagaatcaccaaattcagctgggtgcagtggctcacgctacgcctataatcctagcactttgggaggtcgaggtgggtgaatcacttgaggccaggagttccagaccagcctggccagtatggagaaactctatctctactaaaaatacaaaaactagccaggcatggtggtgcacgcctgtaatcccagctacttgggtggctgaggcacaagaatcacttgaacctgagaggtagaggctacagtgagccgagatcacgccactgcagtcccacctgggcaacacagcaagaccctacctcaaaaacaaaaacaaatacaaaccaaaacaaaacaaaacaccccatcacattcagaaaaagtcaaaagtctgtactatatttcagtggtaacagatctctttgtattctaatgtctcaggagcacatattaaaaaactaattgtaagttaactcaattccatttctagccaaatttctaaaaacctttctatgaagctcacttttaagacttagccctaacaccgcaatctgacagtattatccacgtacagttagaataaaaatgtttaagaatttaatgttcctgacattccttatgaatgtaaataacaaactacaacttgaattgtactgatataatatataagcagtctgttaattacatctaaaaatcatacacttgttttgtggtaatgaaaaatcatcttctgatgcctacagtaactattctcttgaaagtaatcattataatgcttttcagtaagggcttaattttcttatagtatgtcagtaatagtctcagaaaaactaccttctactttcaaattaaccaaatcccatcccactcaaaaccacaataacataatgaaatgggtcaagttttaataacttacttgatctatgatttgctttattgtatgcaggcgaataatgccagagctacgttggtcagttccagcgtctcgtggttcactctctattcattatgtcaggacaaaaataagacatcaaattttcactggttagacaggagtttctcaactactggccacaactgatatgccggactggatagtactttgtttgtggaaactgtcttatgcatgcagtacttaaagtgagttttaatatgcatacttccctttttttttttcactattttttcaactactttaatattctggaaaaaaacttagccattaaagaagaaaaaatatacaggaatgcacatttttttcttttgcctggggctctaatatggctcaacagggcactacttcccaccctttttcacactgtaacatccagagaaaatattatttgtatggcacactgagataaactgagggggctgctcctttgccaagctctaaccagccactactggcttaagaggtcaataccttggcatgtccatcaaccatcggtaatggtgctatagtggattgcctagggagttctgggttagagaccttagttacatcagtagaaggggaacctgggggcaggaagctgttcatctgtaactgtgagacagcctatggcttcatcctggcaacctgtcttcactggtgtatactgtgccaaatgcagcttgggctggtttccaaccaaccatctcagagcacagcaacgtttgtgactctggtcacaaggaaagtttgaaaggaaaggaagagctttggtgtttcagagatcagacaaaggcagagatctggaaagacaagtcacactgaggttcaagataaatgattttggagaatgagactaccataagacaaagcaccatgggcaagcagggcagaatttcaaatctagtgaacactggagaattaagaagaaagatcaactgggaattttggctggaaaaaaaatgctactaactcctcaactcaaaagactgtcattagactcaaagaagatataaaactaagctacctgaattccctgttgtggagtaaacctgattaaaccaatgtattaccctttaaggcagagctttgtaagtcatcatacttgcttttcccatatctaaaaatcctaagtttggttatgggtaagggttaccaccaacttccttcaggtgaaatgtcatctacagataacttagccaggtgcggtggcaggtgcctgtaatcccagccactaggggaggctgagacaggagaatcgcttgaacccaggaggcggaggttgcagtgagctgagattgcgtcagtgcactccaacctgggcaacacagtaagaccttgtctcaaacaaaagaaaacaaaacaaaacaaaacttcttctgaaaaaactaagaaataaacattttctaacttgctcagattttactcaaatcatttgtctgcaaatcttctgatgttcagaaaataaatatccttattcaacttcattggcaatgaaatgaaaagcaatatattaaaaaaaaaagatgatgttctgattctttaaattaacactatgcagtttaaagatgttactgagggtcggctgggtgcagtggctcacgcctgtaatcccagcactttgggaggccgaggtgggcagatcacgaggtcaggagatcgagaccatcctggctaacacggtgaaaccccgtctctactaaaaaaacaaaaaaattagccgggcgtggtggcgggtgcctgtagtcccagctactcgggaggctgaggcaggagaatggcatgaacccaggaggtgaaacttggagcctggatctgagatcgtgccactgcactccagcctgggcgacagagcgagactctgtttcaaaaaaaaaaaaaaaaggttactgagggtcatatagtgccagtgggaacaaaatccccagcacaactctctggaaagcagaaacttcatcataattatgggaacagctatattcttaaggatttaaatcctttgggaaacaaagcagggcataaacaagcaaacaaaatatggacagatttctgtatcttttgtaatagtaatataaattcgaaacaaacgatataaaaaaagcctaactgaaccaaaaattgcaggataaaatgaaaatatgccattacctatgaaaaagaaaaattggatataaacttttctaaacagtataaataaaactttgccaaaatatgcttaaaagagtggaagaaaatacaatggaataaaatttagggtggtgatatgtgtaaaaattaactttccaacttttccaaacacagaatggcacttttataattacaaaaacagtttaaaaataaaacaaaactgggtacagtggctcacacctgtaatcccagcactttgggaggccaaggccagagatcacttgagcccaggagctcaggttcagcctggacaacctagtgagaccctgtttctacaaaaataataataataataataataataaactagccaggcgtgttggcatgtgcctgtagtcctagctgcttggaaggccgaggtgtgtggactgcttgaacccatgagtttgggactacagtgagcaatgatctaaccactgcactcctgcctgggcaagagtgagactctgtctctgaaaaaaaaaaaagaggagcagtgtgaagaagaggcgagaacgacccccggaccgaccaaagcccgcgtgccgctgcatcccacgtccagcacctacgtcctgtcgccaccgccaccatgcccaagagaaaggctgaaggggatgctaagggagataaagccaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtatttctggtgactgtacagtttgaaatacttttatcaagttttataaaaatgcagaattttgttttacttttttttttttttttttaagctatgttgttcgcacacagaacacttcattgttgtttttgggggaaggggcatatgtcactaatagaatgtctccaaaactggattgatgtggagaaaacacctttcccttccagttttgagagacttcctcttggctcccaggaggagggattccttgactttgacacacatggccaccttggcacaaaagccttgtgctatggaaaaacaaatttgtttttatgtcctcttctccctttccacgtttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcgtttcacttcctgaaagtcagggttggcttgtgaaaagttgttaaacaacatgctaaatgtgaaatgtcaaccctcactctcaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaaaagaaagtaaataaaacaaggatctgtaagcaaaacgtatttggcatacaaagcactgcagcctcaatacttatacttactatcttattataaatgtctgcaataacaacagctgataatattagcaatgttttattaccctttttaactatttgtgtatttgtcagtttaatgactaaaagagctggaatggagcaagaaagggctgtggtcaaagccgagtcttgtcacttgttcactgagggccaccaggaagtttagactgaagaaactggaaaggatccacgcaatgaccatccaagtctcaggctactcaactgtaacatggatattatactccttacctcagagcatgactgggaggattcaatgacattgtatgttatgcaattttcatatgaagccaagagtttcctaaacggtgacttttctcattaaaagaattggtggaacaaggacatggtcactggggttttctcaccaaattaaaagaatgggataaactgctaatttttcactgacaaaaagtcttatttttattgaatgagtgaatcagaactcactcactttagaggtgtaactcccaacctcatttaagttagccttgaggctacttacttgcaatttgataaatatctggttcttctcttgccagcttttctctggcaacatcagctattggtccaaaaatggttacaggcctcagaaatccagctggagagaaattcacatgaaaaacagcatattttataccttttctttcttaaacatattgacgttaaagggtattaggttagtctgtagaaaataaactaccttctcgaagaaccactctttcataagctggaaactttgtttgaacaggctgagcggacaaatcctctctgctttttcgaagatttctcttggagctgcgaagacctctgaatctccagaagtcagcacggtctccgcctgctgtttttggaagtgtatactgtacactggctagctgctcagctctacacaagaaaggagaaaattaaaataagggcatttaaaatgcaaaatggaaaaagacccacaatgaaatgaaatatacaatactggatggaagttcacatacagtttaaatcttaatggttataataaagaggagtttgtaaacctaagtcagttatagatacgttgaatacaatgaaaaagaattctttacattaccaaaatttcccagtgggattgaaatgatctatcatcatttacttgattcactctatgagaagtatccaagcattcatacctgttcttattagggatgatgcctcgttctacctccttatgatttttaccaattcgaatagcaagccaagagcccagttttccattgtacaaggtatccacaacacggaacacctctcctttgttaaaactaagtccatagggagattccttttcatattcaaaatgggttctaatatagaaagaatctcctacatctgattctacaatgcgacgataaactaaaaggaataaaaacaaacacattatcaatatttagtgggataacaatctgaaagacagtacattatgtaaagatgctatgataatatcaataataatatccaacaaattcttactatgtgccaggtactgtattatttcatgtattcatcactgtaagaattgaaactcttagtacttccattttgcagatgaggaaactgatgcagaaaatacatcaagtaacttgtcaaaagccacatgcttgttttctattatatcatctaacttatctgcaaacattatagacatttccatatctaaatcagcagttctcaaataaaggtaattttatccctcgccatccaacattggacatttgccaatatgcagttttgactgccccatctgtgtactgaaagggtaaggggtgtgtgctagtggcatctcatctagtgagcagaggctaggaatgcccctaaacatccacaatacacaggacagcccctaaaaccacattatttggtccaaaatgtcaacagtgccaaggctgagaaacctggctctaagtgaaaattgtatcacagaaaaaatggagttttctcttgaattaatgctaataaacatctgagtgtattgcttagaaacatcagtacaaaatctgaaagctgctcatatatacttttgtatggttctgatggctaataaatcaacactttctatcacttgtaaagggttggatggcattttatttaaattagaatactataaaggttagtcctattagcatgctctgctaatgagaatcatctgaaattctgtgctcctaaatgacttagaattacataactttctttgagattaacaaattcattcatcactcaactatgagtgacttattttttaaaaatggaataaatccctttgtaagtcctcaaactctacaggtttatctcctccattttctgacagcatctcaccatccttcttcttctgagccaatatggtcacttcttctcctttagggaggtcaagcaggaaaaggacggcttcttctcttatgatatttgtaaaatctacgttgtttacctaataaataagatttcataaatcattcttggctgtttaagaatatgaaaataacatacgcaggacacagatactctcagtctacctaatttgaaaatatcacatctttttttttttttgagacagagtctcgctctgtcgcccaggctggagtgcaatggcacgatctcagctcactgcaacctccacctcccaggttcaagtgattctcctgcctcagcctcccgagtagctgggattgcaggtgcccaccaccacacccagctaatttttttatatttttagtagagatggggtttcaccatgttgggcaggttggtctcaaactcctgacctcaggtgatccgcccgctttggtctcctaaagtgctgggactacaggcatgagtcaccacacccggccgaaaatatcacatcttttaagaccaaaaactttattttactttggagaaaagaatacactctaattttaaaaaaacagaaacaaataaagtgagttaaaggtataaatttatttaaatagtattcagtgtgtcctgacattaaagatctgtgtaaaatttaaccagtttagatgaaaaaaggtaactttttacaagttgctgagaaaaaaaatcaaaagaaaatgggactaaaaagacaatctgcactgtagcaaccctgtaagagcatctgtgtaatgcaggctcagtgtttgccaagttaatatttacttctattagaagcttctaaatgccaaaatgaacttattaaaatgtcaccagtgactgtgtgcaggattacaggcaggttttcttctttccaccttttggaaattttccagattaaaaaagaaaaaaaaaaaccctagaaacaaaaaaacctgacacgcaccacttacttttatgatacaaaacaaaagtgaactattaagaaacattttttagccaggcgcagtgactcatgtctgtaatcccagcactctgggaggccaaagtaggtggactgcttgaacccaggaatttgagaccagtctgggccacgtggtgaaaccctgcctctacaaaaaatacaaaaatttgccacgtgtggtggctaatgcctgtggtcccagctactcaggaggctgaggggaagaatgtttgagcctaggtgtttaaggctgcagtgagccgtgatcacaccactgcattccagcctgggtgacagtgaggcgctgtctcaaggaaaaaaaaaaaaaaaaaagaaagaaacgtttaaaaaaatgtatgccctgattacttcaaaacagggttaagagatgggtaagaaaataggtctctttactttccttggtatagtgaacgttattatacatgttgtatttaaatgtttttgacctaacttgattgacaacaatgtaaacatcatcagaaagaatgaccatatcagatcagatggaaataggtctgaagtcaccatgatgccttgactttttgacatgctaagtttgaagggaaaaggaggaggattcaatgagaaaatgacagagctcaggaaattgctaagtgaaaagactttgattacgagctgctcacttgagcaaccaaacccaagaaagaggcagtgtagcaagagaagcagagagttaccaacattctccaagttttaaaagtatcagtaaagaggcaggaaaagaataaaaaaatgtaccagaatggcagtattatggaatctaaggaaaaaagtacttcaaaaaagattaagacagtcaaaacgctgctaaaaaataaaggaaaatgaggcttgaggatgacattaactcagcaatggcttattgaaaactgagcttcagtgtggtgaaggtggaagccaggctgcaaaactgtatgaccacaatgattgaaaagaaaacaggcaagggcctcaaccacatccttcaacaagttaaacagcaaaaaaggacaaataagacagtggaagatagatgaagaaccagtggagagagaaagacaagaaagtgaacaaagctacaagattctggagcagacaggaggctgaatccaggacactggcaagaggcaggctgagtacagaaagagaccagaatagagaggccacggcaaagactttgtggtagagaagcagaataaatgtaggagctcacaatggacagataccttctgattaaaatgggacatagtttaatctagcaaatcaaatggaggtttggatattttaaaaagaaacaggagacagattaagatggtactatgtcactaggtgaaaccgtttatggggaaggaagggaggactctatagactctactgatactctgcatctaacctgggctttcctgatttgtgtaactaatcctgtctcttgtggagtatgaagtttcaaagccaggcagcttacacatttgcctttgatgtgaattccatctccctgtgtctgagccattatctggggttaaaaaggtcccagaggttgtgtggattgcttcaagatgactcatatgggagaggaacacttgatgttgcttgctgccaagttgtggcccatggcagagtcctgccagtctgaatgtttagttgaacttccaaagactacctggtagatattatcatcgggatataagacttattttcttttatttccatgaacacgagtggtagaaatgaaatgttacattctttactaacacaaaatatagcagtaaacaagagcaagatacaagaatgggaagtgagaagtccagcataaggtagacctgatggattttgactttcaaagtttaactggctcaatggagactgcttacagattacaatctaattacaatagtaagcttgttgtttgatacctttttctggtgatccaaatactttttaacccacataagttgcaatactgacataccctgagaatttgatcaccttcctctaagccttccttggctgcagggctatcttctagaacgccagctacaaatattccaacatcatttccaccagccagccgcaaacccacactatctccttttctgaattttaccaatttcatgctgggcctgttaaaacagatatttcatttgaaacagttaagaagagcttaaaacgttatagcaatcactacagtgaaaactatattcagaattaaataaagaaccatcatttctaaaacttctctcataccactattttactaaataaaatttagtgttagaattcaaatcagacttaataacactattttctgattaacagttttggaatattcaaatttaatatgcaagtactattttacataactaatttataaaattactttgtaaaacaatgttttctcaactctcaaagagttatggtacattccaaatggctaaaaacatcttccattttttccaccccaattcacacatcatttctattaataactgaaaagtcaaattttttaaaataaaggtagaaattgaagtataaattggctaattttcctaacacgatggactcaaaataaggctccaagcattgtgatttctacatgtaacagagagtgatttttaaaaaaactttgcagttggtggagtctttcagtagttcacagagtagttcacttactctgctgcccctctgagttttacaatacaaatcatatagtcattcagcctttctacattagccccatatccattctgtccctttctagttctctgaatggaaaaaaaaaataatgcatacacacccacctctagcatcagtgtagtgttgaaaccttgtgacattccttaaaacaaatactaaaggatgccttctaagaactgactggatagaaacagactgtaattaaaaattacccactatatttcccttctagggattcataagtactctcacattcctagcaagaaaatacactattttacctattctgacaagaagtgtagaaaaaaatccctatactctttattatgtaatactaaccaaattattagaaactaatagataacaataacaacaacaacaacaaaaagtcaaataaatgaatgaaatgtgttgaggaaggagagatttctagtctctttaagccaactaaagagatcgccttaactttcagaacttactatttattcatttctgattgggttacctgacctggaactaacatcagctagtcataaaagtaagagcctgagaaatcagatgaggtctctcactggctggtggcatccttgatccctccatgaaactatttaccagctttactacaaatggtccaagccccttggttgtagtggtatcctagccaggtcaaaagcattctcatagattcctctcctaaacccattgtactgaaacctctttaaatatttcctcaaagtccttaagactccaggtctcagttgggtgtggcagctcaagcctataatgccagcactttgggagactgaggcaggaggactgcttgagcctaggagtttgttcccagccctgatcaacacagcaagaccctgtcactactaaaaaaaaaaaaaaaaaaaaaaaaaaaattagctgggtttcgtggctcgttgcctatagtcctagctactccgaaggctgaggtgggaggattcctcgagcctaggagtttgaggttatggtgagcaatgatcacaccattatactctagcctgggtgacagagtgaggccctgtctctttaaaacaaagcaaaacaaaaacaaaaacaaaagataggactttggaaatcctcttctaaccctgacccatctaatgtgcttcaaaaagcaaaaacaactgagcacagtatccaccctttagtaaaacatggcttctgaaaaccactgttagaagacagctttaggccatatctcaccaacagtgtcatgtgccttagatgactgacattttatactttgtcctgcctgcattatattaactacttgcagtagcaaaacagactcactaacttctgcatcaaatccattcattggctttaaatgaaaaaccaaacctttcctggcacagctactaatcctgtccacgtcctcaaatcttccttggtatttgttctcccagggaaggaggtctctggaatttttcttttttcttttttgagatggagttttgctctgtcacccaggctggagtgcagtggcgcgatctcggctcactgcaagctccacctcctgggttcatgccattctcctgcctcagcctcccgagtagctgggactacaggcgcccgccaccacgcccggctaatttttttgtatttttagtagagacggggtttcgccgtgttcagccaggatggtctcaatctcctgacctggtgatctgcccacctcggactcccaaagtgctgggattacaggcatgagccactgcgcccggccagtctctggaatcttatcattacagtttcctaaacctcaaacacttacacaagttttcaagcaattcccaagaaaggaaaagaaggggactatctatgcctgcacaatttataaaaggttgaattatcaattacctaatattaaaattgtacagttttaaacttgtaaaaaccccatctctttcaggaactacttctatctacctagctgggtctaaatctaacccacttgaggaaatctgccaattttctttttttttttgagacggagtctcgctctgtcacccaggctagagtgcagtggtgtgacctcggctcactgcaagctccgcctcctgggttcacgccattctcctgcctcaacctcccgagtagctgggactataggcgcccagctaattttttgtatttttagtagagatgggttttcaccatgttagccaggatggtcttgatctcctgacctcgtgattcgcccgcctcggcctcccaaagtgctaggtttacaggcataagccactgcgcccggcccggaattctgtcaattttcaattattcacatcatgtcccctttaccagtgccaataaaaaactaatttgggctgggtacagtggctcacatctgtaatcctagcactttgggaggctgaggttggtggactgcttgagcccaggacttttagaccagcctgggcaatgcggcgaaacaaaaccccgtctctactaaaaatacaaaaattagctaggtgtggtggtgtgtgtcctttcatcccagctactcaggaggctgaggtgggaggattgtttgagcccaagaggcagaggttgcagttagccgagattgcaccacggcactccagcctgggcgacagagcaagaccctgtttaaaaaaaaaaactaaccaaacaaacaaaaaactaatttgataatcatgatggtttgaaatttgtttacaaatttacatctcaattctaccaagtatataatgtaaagtaatgaaaggtgttaagatagtaaaaacttacttttgggttgctaactaccctagaacaggttctcaaccaatctcaaccatgattttgcccccaaggaaacatctggcaatgtctagagataattctaattgtcacaactaggggactgctactggcatctagtggccaggattgctgctaaacatgccacaatgcacaggacagcccctcacaacaaatgcttacctggcccaaaatgccactagtgctgagattgagaaacactgatttttttttttttttaatgctccattggaaagctgtggaaattctgatgtctgaatagaatttttttttttttctaattcctaatttaaaagctaggcaggagacagcggtgagaaagaaagcatccaaaaagttcctttgttgtctaatttctaactcactatcatatataagtagcagaatgttaaatataaaaataatcatagtattaggtggtatgtactattttaaaaaatatatgcaatatggtttacaattaaattcctactctgaataatgttaataatgaacaaagaaaacaatacaactttaaaattgtattaccgaagaatcccatcttcatgagttgaattaggtaggacaccatcagatggactgacaggtaaatccacatctggttgcccaacttgggcatacacaggctttggttctaagaaaaaaaaaattgagtaggactcactttagaaaaacatggaataataatgcaagcaaccaagcaatatatgattcataagttcagagaacctgatgaggaacatatctaccatatgtattagagtacattttatagtaataaattctgaagtctttataacaagtaggtatgttacacagtcacctgtgttttccatagttccagcaatcagaatttgaaaaatctattctttaagaacgaataacaaaaaatagatatgagaagagagaattcctacacttcccagttaagactgccaaagtagctacctttcctcattatgataaaatgtttttaaataaccatatttctgccactcagcaagcagagcaagaaagatgatttgagaaaaggaagtgaaagacatcagaaacaaaatctccaggcctcccaggcaaccgatcttagcaccttgctgattctgttttgtcttcacagacagctttaaaaggatgcttgggtcagacacagtggcttgcacctgtaatcccaacacactaggaagctgaggtgggaggactgtttgaggccaggagttggagaccaacctggacaacaaagcaagattccatctctccaaaacaacaacaaaaaacaaagaaaacccacaaaaaaaccccagaaaacccaaaatagccaggtgcggtggtgcacacctgtaatagggaggatcaggtggaaagacagctggagcccaggagttttgaggttacagcgagctaatcacaccactgcactccagctgggtgacagagtgagactctgtctcaaaaaaaaaaacccaaagacaataaataaaggtatactccataaaatgtttatgaaaacactttcaaaaaagcaaaataacttttctttttaaatttttgaagccaatctcatgtttctctttaaggagcagtgttggaaaacaactttactaattgcaagaagttgttaatgataaatattttctatctagaaagtaaaggaaaacattcatgaaaggcaactgatttgtgccaacctgctacccataaggaaaacgctggaagtcatatgcagacaaattcacacatgagaagaataataattgcatctttaaaatcttctgtaaatcctaacaattacttcactctacttgcaaatgtttcttgaacttagtgtttcgttatgcttacctggaagagaaggtgtttgtttctcatttctttcaactgtaacttcttccactgttttaggtgtgtgatcatcagcatgctttacaggagttgagacagccccaggtttagaaattctctcttcatctctactccggagactgtgtgtcattaaaataaaaaatcaagagcataagaatgattctggaaagcatctgtaagagaacagtataagaagaggcaatgcaacttcaaaaacaatgacaacctgctctaacagataccaaaatattgtaaaaacctagtaattaaaaatagagcattaccacagaaaaaccaaatagattcatgtaataaaatcgaaaatgaagaaatatatctataatagcaaaatttatcatgaaagtagcattccaaacaaaactgttggagaaggaacataacatttaataaatggtgtcgggacaactgtccacaaatgtagaaaaattagatccgtatgtttaacaatgacaaaaataaactgatttcagatgaaatcaagtcctaaaaaaagagtttaaacattcacataatcaacaggagtcttctaaagtaagactcaatgaagccacagtatatcaacaaaagtgattacataaaaataaagtacgtgcaaataattgggaaacatatataatactgggctgaactaaatgaaatgggaattctttagttcaaacagctcgatgttaactatttcatacagtttaactaaatacaaatgttgactatgtactgacctaagtaacatatataagaatttggtacttaaaaaaagaaaagacaggcatgatggctcacgtctgtaattccagcactttgggaggccaaggcaagaggactgcttgagcccaggagtttgagaccagctgggcaacatagcaaattccatactctgtaaaaaaaatttaaaatttagccaggcactgtcacttgttcctacagtcctagctatttaagtggctgaggtgggagaattgcttgagccgaggagttggaggctgaagtgagctatgatagagccactacactccagcctaggcaacagaacaagactccgtctctttgaaaaagaaaaaaagaactataaatcaatcaagacaactcaagagagaaatgcaaaaatacaaagaagcttttcagcaaaaaggatgtacaaatacgtaataaatatgcaaacacatttaacctcactaggaactagggaaatacaaattaattagaaactgtattatcggccgggcacagtagctcatgcctgtattcccagcattttgggaggcagaggcaggcggatcacgaggtcaagaaatcaagaccatcctggccagtaaggtgaaaccctgtctctactaaaaatacaaaaattagcccggcgtggtggcatgcgcctatagtcccagctactcgtgaggctgaggcaggagaatcaattgaacccaggaggcagaggttgcagtgagccaagatcgtgccactgcactccagcttggtgacagagcaagactctgtctcaaaaaaaagaaatcatattatcatccatgagaactttcacatgataacatcactggtagggaaagatatggagaaacagacatattcacaaaatgatggtaaaagtgtatgactatttgaaggcaaaatggaaattatcaaaacaaaaaatgtaactaggtcatacactataattccacttctatatttattctagagaaatacaaatgtactcaagaaaacatttataagaacattcattctagtatcagttttagtggcaagaaacaaaataaaactaaatgttcattaataatttccccagataaacagaaatcataaagtgtaccaagacaatatatattttaaaagaagccaataaatatatcttgaataaaaagataaatcaagatctataattttacaaagtatcacgtatatatggttttacagctgcattctcccaacctcggaaaaacaaaataatttgtttaattatcctggaccacagaaaaatataaaaagctctctaattcacttaaaaaaaaactttatttccaaacatatacagccatacagagaacagtatcataaaaccccatgtactcatcgtcgacaattatcaatactctagtcatcagcattccaatctgaggctaccagaacctttaacatccaaatcttgatgacaagagtacaaagagagaaaataatatatttttcattatgaatggaggaaaaaattctaaataaataaaatactagctaggagaatacagtagtgtattagaagactatcatcagggttatttcaagggtgcaagattagttcgacattaggaatttactgacacaattcattattatgcacaaatatttacagaaaaaagtgttaatatcaaactggcatgagaaaatttgcagtcattcctaaacaaaaactgaaataagcaatataattatgaaagaaactattttctaaaaccaagagcaaacatcctatcaaatagtgaaatgctgaatgtatttacactatttacaccaaactcagtaacaggacagtgatacctgtgaacactactgttattcactctgattttgaagacccaggtagtataatcacgagctaatggtcccaaaatattgaaaaaaaaaaaaaaacttaatgaatattaaagactactgaaaaatttcctgaattaagataattttaattacataaaaaaatcttttgtcaatatcgtcaacaatcagatggaaatgaaagggaaaaaataacaccagtaacaagaacattaaacattctaaaactttagactgggggaagcctttgcaagtaggatagaaattcggaagccataaaggcaagataaaaatatctgacaagattaaaaacttttacttgcacaggaaaagatattataaagacttacatttgaaacacagctatatcagtaatctggtactagccattaaaaattttgaacaacacaaacacactctttaaggactttagaaataaaatgcaccagcacagtacatgaaatcaggtacgaaggtgcttactgccatgttttcgcaggcaaatacctagaaacaagatgtccataatacggaaagtttcttatcaaaagaataaactggatgttcaccttgtattgttcaactgaaataatttagctgagtaataattcaaatcctgatctcttaattattaaaagaaaaacccaaaccctatatatgataccaaatgtcagtacgagtctggagaatggcttaattcaagaagagtgagaactgggggtgaactgggggtgaagtggagttggtggatttgatctatttcacttgttctaataagcatgcattgtttgtaaaagactattaaaattaggtgtaatgaaatagaatgatatgtacagacatgaaaactttaaaacggctgggcgcagtggctcacgcctgtaatcccagcactttgggaggctgaggcgggcggatcacaaggtcagaagatcgagaccatcctggctacgggtgaaaccctgtctctactaaaaatacaaaaaaaattggctgggcgtggtggcgggagcctgcagtcccagctactctggaggctgaggcaggagaatggcgtgaacccgggaggcggagcttgcagtgagcccagatggagccactgcactccagcctggacgacagagtgagactccgtctcaaaaaaaaaaaaagaaagaaaataacttcaaaacaaaatgccaaataagacacacagattacagaatacatatagcaggataccatatagctatttaaaaacttttctctaaaatataaacagacatgtttgcacatgcccatgtacagacaagcaacagataccaaataagcaacagtggttcaccttggagggaaaaatagccaaaatagtagccaagaggaattttacagttatctctactatttcaacttttacaaaaatttacttattataataaagattgaaaaaatatatttaaaattatttttaaagactaactttaaacataaaatttggttttattaacgtatattattagtagtctcttttcaggaaaaggtttctttctatgttgtcttcctgaaggaataaaaaataagtactttgcatagtttctatttttgtattcttttaaccattctgtggaggtgtattctacttttaagttggtatattcttaatgagctgcactgaagtagaacaatcttttaggaaaaaaaaaaaagccaagatattttctagctcaaacaaggatgagctacttttaaattggaaaagattggccggttaaatatgcaaatgatgtttaacatgaaacatcactcctgtaatcccagcactttgggaggccgaggtcggtggatcacctgaggtcaggagttcgagatcagcctgaccaacatggtgaaaacccctctctactaaaaaaacaaaaattagttgggtgtggtggcacgcacctgtaatcccagatacttcggaggttgaggcacaagaatcgcttaaacctgggaggcagaggttgcagtgagccgatattgcgccactgcactccagcctgggcaagacagcgagactttgtctcaataaataaataaataaatacaataaattgtaaaagatcaaaatttttagccattacttgtgtaataaaatatcacaattagctaagtataaatcaacaaaattaagctctatccccaaattgtgctgtgctcctcagattaaaagggaagtgcaaaatagtaaattatcctgcattgtttgcattaaaaaatatgattaatatattataaatacaaaattatttttaaaaagagaaaagtgaaaaaataagttaaaatgagtatttttaaagagaatgagttacccacaaaattttaatagttctacagatttctattgctctgtacaaagcagaatttgtttagaaaaggtaagaattccaattaattttcttctttcttgtaactgatcaaaacttctaaaaattaaaatgtgattaacagacattaccatcttggtattttaacttacaatattttaactcaaatgctctcctcaatgataaacgataggtcgtcattggctatacatgtagggctcttgctccatatatcacacaaaacttctgggagtatttttatctttggccaatttgcataccccattgctaattacctttttgtcctgtgatacaatcattataacattaaatgcaattagccttccaaaacaacatttcacataaatgggactcacaccattctattcaatttttcatacaattaatatttgaaatattagcttttgttagtgcatttccattatctaccaaaagatggaggcatttttcaataatacataaagatctagaacagtactgtttaagagaattataaaatgagctgcttacgtaattaaaaattttctagaatccatgttaaataaaataaggcgaaatcaatttataaattttattactcaatgtatctaaagtagtatttcatcatctaagttattaatgaggtattttacattttttgcatactgtgttttcaaaatccaatgtgcatttcacactaacaatacacctcgatttggactggccacatttcaaatgttgaacagtgacatgtggctactggctatggtgttggactatgcagatctagagttacagcacaaaataaaataatcaacttttccaaacattaaaatgttctttcacaagcaaatgtgactatgaagtcaagataaaatctgaatttacacatgaaattagtcaacaatcagtggcaattattgaaagaaattgtgaggttgtgataatgaatcacatttttcccaaaccttcctaattcttttttttttttttttttttttttttttgagtcagggtctcaatgttgccctggctggagtgcagtggcacaatcatacttcactgcagcctcaacctcccaggctcaagcaatcctcccacctcagcctgcaagagtagctggactacagatgcgtgccaccataccctgctaactttttctacttgttgtagagatggggtttcgctatgttgcccaggcgagtctcgaacttctgggttcaagttatcctcctacttcggcttccaaaagtgctggattacaggtgcaagccaccatgcccagcccttcctcacataattctatcctaatggctctccatatttaagcttaaaaatgtgtgtgtgtgtgtgtgtgtgtgtgtgtgtgcgcgtgtgtgcgcgcgcgcgtttgctattatgaggaaagctttctataaaaattatgtgttcggagtcaggttcatgtttacgtattccagctcctggtagcctagaaggaaactttgggcattttaaggtacctcaagatcctcttatgggcacttttgcttttccccagaagggtaagacgagtttctgttgtttttttttttttgtattaacttgcacgtattaatctaaaggtaatgaccttgttatctggaggctatgagctagttgaaagctctagacaagacagctgacaaagatggactggaaaggagtctctgagagagattttataggtcacatgaacggactcactgttaagcagagcctactttaggtcttacccaatcaaatgtgtgaccagtgtagccgattaatacacactcaattagattagcaaggagtaacatgctgtttcaagtaaaaaactttggttgtgaaattgcagctgtttggagccatttagtagaggcagagggcatgcagcatggtcagtacagggtcctggggagacgctgtaggagagaaggtgcatcccctcagcatgctcctgcagtgcccagcatcctaaagtactcggtggccagcagcctgctccagagactctctcaaacggttctgttgtgtgaagtctcccatgagatacctccccagcacatgggagtacaaataccatgcaagttcgtctggtgacataccacagcaaattctcggccactcagtgagcaccgttgttccctttccaagaaggccagatctcagccctgaggatgagtgagtgggagcctcttcctttggcactctatctcagcaccaaggagagtagctgctccttctatctgtggttcttttgtgctttgtttttgagacggagtcacgctctgtcacccaggctggagtgcagtgacgcaatctcggctcactgcaacctccgcctcctgggttcaagttattctcctgtctcagcctcctgagtagctgggattacaggagcatgccactgtgtccggctaatttttttttttttttgagactgagtctcggtctgtcacccaggctggaagtgcagtggtgcgatcctggctcactgcaagctccgcctcccgggttcacgccattctcctgcctcagtctcccgagcagctggactacaggcacgtgccaccacgcccagctaattttttgtatttttagtagagacagggtttcaccgtgttagccaggatggtcttgatctgccctcatgatcagcccgcctcagcctcccaaagtgctgggattacaggcgtgagccaccacgcccggcctaattttttgtattttagtagagacagggtttcaccgtgttgcccaggctggtcttgaactcctgagttcaggcaatctgctcgcctcggcctcccaaagtgctgagattacaggtgtgagccactgcgcccagccctatccgtggttcttaatcttcagagctctctttagttcttaccagtcaatccctcattactcctgttatgtttaatttctttacattcaactttctctgttcatggaaactgtgctttctgtctcctgattgataagatatgcctggtcgccatttcatagccctttccctcttacttctagctctatgaacacctttccaatcaacttgatgtgccttattttaaaaataaccttaatacaggaaataaatgaagcgctgaacattcactctagtagaatatccttttataaagccaactccccattacaaattaaagacttatactacaaaaacggatttatacatacttttcacaagttcattaattgcataaggtaggcaagaacaccacagtttaggttgaaaacaaaagctagctactaatccctttaaaaggcattggattatctcaaccacaattaacaataaaaatatgctaagaatttaagttaactgtattccaaagttttttccactgacaggaaaatttcagcctggaaggctctattgcaaaaagacagaaaagtgaaggcacactccagtttcatacttagaatgttgcaatcactgctaatcctctgattttatatggaaacaaatatatacacattgaagttcccccttcacaacgattaaaaaatggtctctctctgcactggtacccaaagaattctggggatgagaaagcaagagatacagggctggtacttgggaacaaaaggtaaaaaagttgcccaggaagtatgctgagaaggcaagaaaataattaccttaattccactttgtcattttgtaagctaatttctcacaatgtaaatctgtcctttacatgtaatctgctttctaaaacatacatgtgttcatgagcatgcttctgaaaaaatctgagtctatttcactgtgatattgtttttaggcaataatttagatgtatgtgtttgtggagcttattcttctgtacaagtgcttctcatcttaaacattcatctattaatctagtccatccgcattagaagaaaaacaggtctgtggttcaaaagtaattttcatggatatggacaacttttagtaagaaacaactgaggaaagcccaagaggacttttgtctcacttaaagaattgtgttgttacaccttcattggtggtataatgattattctgtactttgactaatacttatgactaacatagcactttgtgcagtttatttggtagattttatagtgggagaccaatgtcacaaatcttattaggattctctcagagaaaacagaaaattgtctcacatttaaaaaatctgcaaataagtttttttgtatatttactattttagacaagtggagcagtttgtttttaaatttgccatttttaaatattgtacttgtagaagaaaacaaatctcagctgatggagtaaataaactttatacttttactttttatttttgtactacttatttttgagacagggccttgttctattgcccaggctacagttcagtggcgtgatcatggcacactgcagcctcaacctcttgggctcaagcaggcgatccttccacctcagcctcctgagtacccaggatcacagatgtgcaccaccacgcccggctaaatacacttttttttttttttccccccagacggagtctcgctctgtcacccaggctggagtgcagtggcatgatctcggctcactgcaacctctgcctcccaggttcaagcgattctcctgcctcagccttccgagtagctgggattataggcacacgccaccacgcctagctaattttggtatttttagtagagactgggtttcaccatgttggccaggctggtcttgaactcctgacctcaagtgatcttgcccaccttggcctcccaaagtgctgagattacaggtgtaagccatcgtgcctggcctactttcactttttaaacgggatatatgataaatattgaagcctgcctttctgctatttgatccatgatctcctcttaagggttaaaatctaacagcaatcactgaataccccatgactatacttgggtttccattaactagagaaacttaatcaactaaaatcttccctcttttggcccctcacaaaagcacactgaaaataaaacctcacattggaatttcaatgaagtaacctgaaatcccctcaaactgaaaataacagttcgttcacaaaagttcaggatgtcatcgatattccactcactttgaaatgttagataaaacatattagcaaaaaagcatttaataacatttcaagtaataaacaacattaaaaaaactttcatgttctaaccaaattttttaaaacagaaaaaattcacttcttggatctccaaatcactttctcccttgctcttatgatgtagccacatgggctatattgctgcccttccagtaggtcgagtttccatctcaggagcagtacacgctttgccttattccagaatgaccttcacctgccagggtctttcttacccagttcaaaatgatgtgacctcagagaagctttcttccctgagcctgttatttaatattgtcccctcctgcttcactattacactaccctgattctctttatagcatttaaccactaacgaaaatttactttttgtattttcaaatttatgtatttgctttggatatagagcttacatccaaatgatagcagggatcttgcctaagattgctcaggatatggccaggcgcagtggctcacgcctgtaatcccagcactttgggaggctgaggcaggcagatcacgaggtcaggagatcgagaccatcctggctaacacagtgaaaccccgtctctactaaaaaacacaaaaaattagccaggcgtggtggcgggtgcctgtagtcccagctactcaggaggctgaggcaggagaatagcgtgaacctgggaggcggagctcgcagtgagccgagatcgtgccactgcactccagcctgggagacagagcaagactctgtgtcaaaaaaaaaaaaaaaaaaaaaaaaaagattgctcaggatatttatcgccatacactgataacatatatgtgacattagtaagtatttggcaaaggacgaatgagcaggataacatccacattactggtaaaatctttcaaccttcactacagaaggaacattcactgtggtgccgcctgttgatcactcagaactatgcacattggtcacggtgtaaggtacaggagccatgggaaagaagtcactgattcgactcgctgattaaccattgaaatacttaatgaatcatatctttctaactggcaccctttctatctttctcagatgaaagggaaacagaaaaaaaaaaaaaaaacaaaggtaaaggacctcatggtgagcctaaaaaagaacacgtagtactaccaacaccatgttcactaccaacaatatatgtaattcttgtttagaataaagcacttatcaaattggagttatgaaatttatttagacaaaagactaacaccaatgatcagtaaataaaatctgaaactcaccaatcagggtatatacccaaggaatataaatcattctaccataaagacatatgcaaacaaatgttcactgcagcactattcacaatagcaaagacatggagtcaacctatatgcccaccaatgacagagtggataaagaaaatgtggtacatatacaccatggaatactatgcagccataaaaaagaacatgtcttttgccagaacatgagtggagctggaggccattacccttagcaaacgaatgcaggaacagaaaaccaaacactgcatgttctcacttgtaagtgggagctaaatggtaagaacttacgaacacaaagaaaacaacaggcactggggtctacttgaggggggagggtaggaggagggagaacaagagaaaactattggatactgggtttaacatctgggtgatgaaatagtacgtacaaaacacgatgacacatgtttacctacgtaacaaacctgcatatgtacccctaaacctaaaagtcaaaaaaattaaaaagaaattcactagtcagaagatcgttacctctccacatttgaaatagaaaaaaaaatgctcatcaatattaggatgtttcaacaataatttttagcctattggcaaagttgcacaggttaagcatcccttgcctaaaatgcttgggaccagaactgttttggatttcggattttggaatatgtgcatcatactggttacccattgagcagccctaatctgaaaatgcaaagtctgaaatgcatttcccttgagcgtcatgttggcactcaagttttggattttggagcattttggattttgcactttcagattacctacgctcaacctgtatgtaagtttcagagaaaattaagcaatatgtgacagaaactatatacagtaagatgaaataatatttatagttctcaaatgctgacgaaaacaattatggaaggtagaggaaaaggtgtgtaaataaaaaactagatctttaatttaaaagctaagaccacataaggatattttaatcaacaatggaccccacagacaatagtggtccctgaagattaaaatactgtagttgtactgtcctttcctacgtttaagatacacaaatgctaactgctgtttcaactgcctacagtatttggtacagtaacctgctgtacaggtttgtagcctaggagcaataggctacaccatatagcctgggtgtgtggcaggctctaccacctaggtttgtgtaagtacactctatgatgttcacacaaggatgcatttctcagaaggtatccccatcaagtgacacgtgactgcacattatatgctctacctgcatgtttatttggacttactcagcactcttggaaaactcctaatatggagtggattgtatagataagaggttttgatcccaaatatatgatcttaacttggccaaacgtgaatttaggctaaaaatttctgattcagaaaattcaattttactgtcatgtatttgctgtatcataagctgtatcaatgctgacacaccttttactttagaattcagtagaggcatttctcaggaggaacaatgaatgaagagattaaataactgttacaaagtttcaatcttctgaaaacactgcttttaagtttctcagaactaaccattttcgtaaaatggatttgctaaatataaactggactgtttttctatttgtgaaaacacattccccaaacactttagaaaacagtttaggccttagatgaactctgttggtttcagggaatgagtgtaacaaatgtaaatgggtagaatgccaaatgtaaatcttgacaatccaaatttcccacatttcaatttcatcctgttagtctgaacttttactgtaatagaattttttcaatattgtacctgcttatgactaatcatgctcacttttataaaaatttatagaataaaaaaggtaaacacctgttgttccctctaacatacaatgttagagggaaacataaaatgggtctgttaaaatagctgtaaatatgaggaagaatacaatctaaccaagcagaggcctagatcataccctgcaaatcaaatactctctacttatgcagggactacaggaagatcagtgaaatctcttttcaatgatacccactcagtaatcaccaagaagcaaagtgtcaccatcaactgtgggctctctcagtattcccagctcctacagcccaagtcttggcccagactgggctctgcaacaatactaagtgaaatacaaaacaaagcaaacaagcccagcaacaagcatcaagttataagaaaaccactgtaattattttccctatgtatatgtattttttgaatttaaaaacaaaactattttaacattccagacaaagcatttggaaactttttctgtaattgactcccttggccatatagtctctcttataacttcttgattatgccattgtggaatgggtttccaataaaactttacaaaaggaggaggctggatttagcccacacagtgcagtctgccaactccagttctagacaacagtgaggatactttgttcatctaattataatgaagaacaagcttgtgtgtttttctcagaattctctccatatgtttgctctctaagaaaagaatatcacacagaggaacataagtaggtcatgacaacaatggaacgctggtagattttagtttcctgaagattaagtagtaattaagctatgaaatttctttctctacaccagtaaggtcaaagatttgggtcaaagagccaacagttttaatcctggccccaatcccaggtcaacaacataaccctggactttattgcaacctctcaattttagtttgcttaactatatagaatgaggaaatctcagaaaatggttaaatacaagcagataagaaagcacatttggaaattctaacttatgatactattattactactatgaatcaccataataattacagtagcgaacacatgtgccaggtattgtaataactaatttctcaccattctgtaacgtatgacctgcctgcttcactgcatatggggatgctgaaacacagaggtttcaaggttatgcaagtaaccaaaggcaggctgggacatgaacccaggaagtccggctccaaagccctaagaattcactatattctatcacttctcacaaaatgaagatgaagaggttattattctcagcagataatcgcacatcctaaaaatatacaaaagtattcagaaatctaggaagagaacagggcagggctgatgtttgccaagacagacttccttttacactcaagtgaaacctttctcacagagaccaggtcatttttttatcacttctttaaagataatttacatacaatttgtaaaacaaaaagacacttatacagccaaaattaaataaaaaaaacaaaagactatatatggaagtcctttagtgtttttttacactagcattttactcttataatgtatctaagttgtttctcaaaatgcagggaatgctctaaattaaaactccacagttacaggatttgaagattcaactttggggtggaaatgaaacctttaagcaactggtactatttatatcttgtctgtaggcagattactaaattttcaggaattaaattctcaccacaaaaaatatgaaaagaacctgaagagatttttccttctgtagttgaagttaccttttcttttatacactatactttctaaccattagttcccacatctagcagtgcacataagagaaagatgccaggagcttaaaaacaaaaaaatacagttgacccttgaagagcatgagatttaactgtgtgggtccacttacactcgaattttcttccacctctgccacccatgatacagaaagaccaacctctcctattcctcagacgactaaatgtgaaaacaaggatgaaggaaatgagcagtgaaggaaaacgaggatgaagacctttatgatgatccactttcacctaatgaacagtaaatgtattttctcttatgattttcttattaacactttcttttctttagcttactttaagaatactgaatataatacatctaacctacaaactttgtactgtttatgttatcagtaagcttccactcaacagtaggctattaatagttaagtttttgggaagttaaaaatcacaggtggatttttgactgtgtgtcgggggtgagagggaggttttggtcccccctaaaccccaggttgttcgagggtcaaatgtattgcctgcttccgtctcagatcagctgaaagcaagccccagaagtttgtatttttaaaagctcccatattactggtgctacccatgaaaatacttaagatacctaggagaaaaaaaaatcacaatataacacaaaaatagtaattttaggggggaaaaaccctccacttttaagttaaggttacagattctaagtgctgaggaactctaaatgaagaaagtggacatcaaaaagaattttctaagattgaaaattttttacaatctaaactaatggcccaacatttgagattttgattcagattgcgttatttaaaaggggaaatcatgtccaaattacttaagcatggtttctagctgagaaatagatgttaaaattacagctgctcccgtgaatcatcaaaggtgctatatcactgtgtgtgtgtatgtgttgcggcagtaatccttttcctgataacaatctatgctgtgccaggaagatttttagaatatattaactgcagcaattaaaaatcatcatcagttataagataagccaactttacacgtaacatgccataatattcctttaaaaaatcattacatccttaaaataaacaccagggttctcataatttataaatctaggtttgaaatttagaaataatcagcttcacaaatacataaaaactacagtagatacgaattagcaaccacattcatagctcttacaagttatcctcttctcttactagttcccattttagtagaatgcgaaacactttacagttttaactaccactgtcactgcggttttttacaaactttaaaaaagctctctcctggctaggtacgcctcccttttcttacttctccctcgcctcttcaccttcctaaaagaacgtgctccctgttatccagttctctgccttctttccaaactgtttctcttagcaattttagtgacttctatggcttcagctaacacctctatgcaagttaagtctcaattcaacatctctaatcctaaatcatctcttcagatctagacccaaatttactttttctttccagctttactgaggtccaattgacaaataaacattgtatctattaaaggtgtacaacagtgatgttttgatatacatattcaaatgatgaccgagaccaagttaattaacatatccatacctcatagttacttttcttagtgtgtgtcaaaagaatgccttaagatctactctcttagcaaatttcaagtatacgttattaactcttgtcactacactgtaaattaggtctccagaacttactcatcttataattgaaactgtgtaccctttaacaaacatctccccattcctccccacccctaacccctggtaaccaccattctactgtctgtttctatgagttcaacttgcttaggttccacagtaagtgaggtcatgcagtgtttgtctttctgtgtctggtttatttcacttagcacaatgccctccaggttcatccatgttgttccaaatggcaggatttccttctttttaaaggctaaatcacatttcattgtgtgtgtgaacattttctttatccattcatgtgttcgacattcaggttgactccataccttggctattgtgaataatgctgcaacaaacatgagagtgcagatatctcttcgagacagtgatttcatttcctttggatatgtacccagaagtggaattgctggatcatgtgctagttcgttctggttttaattttttgaggaacctccatactgttttccagaatggccgtatcaattacattctcatcaacaacgtataagggttcccttttcttctaaactgtctcttcagccctggactcatgtttcaagtgatcttcatgtggactgcagttaaccatgggtcaggtggtggcctatagagccttgggagtctccagaaattgtatgcaattgctgcgtgtatgtgcacatgcacatttttctggagagaaggatcataattttcttcagattctcaaatgtacgtgtgactctaaagaaagataaactcaggtaggtcatatactaccagtataccagaacctttggcataaatactagtgttttgttttgtttttgagaaagagttccgctctgtcaccaaggctggagtgcagtggtgcgatctcggctcactgcaacctccgcttcccaggttcaagcaattctcatgtctcagcctcccgagtagctgggattacaagcatgtgccaacactacctggctaatttttgtatttttagtagagacagagtttcaccatgtcggccaggctggtcttgatctcctggcctcaagtgatccgcctgcctcggcctcccaaagtgctgggattacaggtgtgagccaccgcgcccggccaacactagtgtatttttaaaagagaaaacaaagtccaggttaatgtgtttattaaaggacttctgtagttaactttcccaagcagtagatttctgaagcttgctagcatcttctaatgcaatagtatgacaaactgcagctgcggatcaaccgcttttgtaaataaagttttatgggaacatagtcatgcccattcatttacacattgtctatggttgcttttgcagttgagcagtgaaaagaactatatggcctgcatgattgaaatatgtttactatctggccctttaagggaaagtttgcggttattttagatttaaaaaatgtctaagttgagaaaaacagatctaatcttgaataatcaaaagaaatacatcttttaattttatttgtaagcaatttcagatactggtatcaagcaaacaaaacccctgtattttttaaaaaaatagggtgtcttacctgccattgcttggctgctgcggcgagtgcctggaatgatcagaaggctctgaccgctggtcaggagatcgtgaccggctgcggcggggaggcctatcgtgtgatcgaccagaatgatctgatgccagtgactgaatttctgaaatgtctgttaataaaagggtgctacttattttcccacaaaaataattacagtcaagtataaggtactccagtaataatgaagataagctagtaagtaaaattatatataaaatggaagatttatgcattaatttcacctgccagcaatcatatcaatagtggtgagttgtctacaggaaaaaatgtatataaaacttatagattttgaaggtgtttggctggtagaaaattatcatttcattcaaagatgttcaatctccctagtattttaagaaaataggtcacttagagggaacgttcaaacagaatcacactcaccgtctctctcagaggcattagcagagtggatgctgtcagaaagatcagggacattcaatagcgtagcccgttcatctctttgaactaccatttttaatttgcctttagacctttctatcaatgtctttgcatctgtcaatgacatattttctgtcacagtaccatttatctgcaacagaaaataaattacagcttgaaagtaaataataaaatacaaatgttaacttagtttgttataaacagaaatatccaaaccactccttgctatgaaaaccaaaatattctctctacacttttccaaactgtcaaagtattccaccttcttgagatgataaaatctttactgtactgttgctgtcagaaaaacccatagtagcatcccctaactccttctttgaggctgtcactttctattacttataaacaaacgaataaataagcatttcaatagtatctggaagcaattatcagaactttttaatgtgtaagaacagacatatctatctacaaagtagtaccggcctgtgaataattatctcaggatgaccctgtgatacctaaagcattggtgtcgacatgtaataatgcataaagggaatttatatccctctcccccaaacactgatttttaattctctttggcaaaactgcttcaaacaagagcacagactacatggtaactctagaacttgttttctatttcagttcattaaaaagtaagaatatgattataccttcaatacaacatcaccttcttgaatattgccatctcttgctgccaaactatcttgtgaaatttccttaacaaatatatggcttgccaatcgaagaccatattctgaaataatgtaagtaagtgtttttagtataacatcctaagacacctaaatagattttacaagtatacaactaaactaattaactactgcatagagttttcaagtacaatcaataacaagaaatatttcttggccatcctgcaaataagacattccctctaattagcaagtctgcaatgtctccgtgaaagccaagggaaagtgtatggttcaaacgaaggactgatagaccgtgttcccatattactgaaaaggagaaaatccccaagaggacaccatttctttttgaccaagcattgatacactagctcttcagaatgattaaggaatacaattttctttaagagacagggtctcactatgttgcccaggctggacttgaattcctggggccaaaaaaccctcctgcctcaggctccagagtagctgggactaacagacatgtgtcacactatgcctggctagagatataattctaaagagtaaactgcttgaggtttgaaaaactttgaaaagattgaccattttattgatgactattatcatgcatatactacttctatttttcccagctcctagaccaaaaatatttctgatcctatacaccccatgacactggatagacatactcagagtactagcatgtactaagcatgagtgcaaaggcttacaaccagccaggcagatgtgggcaggagttataatgccaatcctttcctttaaacaaccaacaaagtatccaagagtgagaacatcactccgtctgtgggtaaggaatgttggaagttgaggaaattactagcagagtccagagaactgcccaggttcctgcaacagctgcagaaaaacatattttaagaaaaataagaacaatgactacaactatcaatataatgtcaatagtaaaaggattgcccctggttctgtgaggagagtcttactgcattaaaaacaaaatcaaaaaccaagatggaaaacagaaaactgttttaacatgggataaattaacagacctattacctaagtgtttaaaaattacataagagtaggctgggcatggtggctcatgcctgtaattccagcactttgggaggccaaggcgggcggaccacaaggtcaggagttcgagaccagcctggctagcatggtaaaaccgtctctattaaaaatacaaaaaattagctgggcatggtggtgcacacctataatcccagctacttgggaggctgagggaggagaactgcttgaacctgggaggcagaggttgcagtgaactgagattgtgccactgcactccaagcctgagagagagagtgagactccgtctcaaaaaaaaaaaaaaaaattacatcagaattacagtttaacttaagacaaatatacaaagagtactcacagccagaaatagaatcagggtgaagaaaacggccttttaggatatctgggcaaggaatgaggcagtcatccatatggtcattacatcacagaaggatagggtattggttaaaagactgttcttcaagattaaacacttataaatgaccattacacagatgaccccaaaatatttcttgtatattagtttgttcgttcattctaaatatttcttggggtatatatgaactaggtaccaggcattagggagaaagcagcaaatgagatagttcctgcactctggcaatttgcagtcagtgaaaaaaaggatgttagcatggtaatcccaaatgcggtgagttcagagggcagaaacacaagggttcttcacttactagggggaaggagaaggccgccctgaggaagatatactaaagttaaaactttacctaagaaagacctaaacctgaagggtatgtttgtgggggaggggatgcatggggtgagtgacggctgaaaagttcaaaacaaatgcatcaaagtaatgaagaaaaaaacctggtggacctaatgaagtcataagtctagtgtagctgagactgagaactaataaagaaaggggcaaaagagtaagacagaagtgtcacagaggatctatgaagaaatctgcagaatcaacttaaagggatccaagagacaacctatgagaccaaatgagtctatgtaagagatgacagtggcttggaaaagggtggaggcagtggagaaagagtgggatggataagagtggtattcaggagtgaggacattcatcatgcatgggaaaaaaagagaaggcaagggtaactaccatgtcatctgggaatggcctgagaaactggatcaatagaaacacattcaactgaatacttcatgagaaatacaaagaaaaattttaagagggagatgagtttcatttgagatgtgctgtgtttcagggacctacaggaacatctaagtgaatatgcctaacagttggaacacaagagtgtaaagatttgggctggagaaagaggttctgccatcatcagcagtgactggaagcaggggagcagatgagattgcctaaattaattgttattcaacctgaggaaaagaaaaaaaaagttaccttaagtggaaaaaaagattctaggagagaaactgacagaacgttataaagggcagggtgaggagaatgagcttgcaaaagatacagaaaggtgggggaaaaaaacagaaagatacagtactaccaaagaagacattatttttgaaaataaggagtggttaaccatgtgaaatgatactgaaaaggcaagcaagctagagactgaaaaacttccactagatttagtgtgaacatttttgggggcagagcggaaaagataccagaccagagaggattgaggggtaagtagtgaagtaaaaacagcaaatgttgacaacttcactgagacttcactgaatgggggtatggaataccacctaggagatatgccaagtggtaaagcagatcaaagtaagtcttgataatattccaactgtaacaccctttatatcaaaatgatcagtcatgcatgcccacagaaggagcaagccacagtcagatccattttttatcaaatttaatgaggcatgagggaaagcagctgagtttcagtttcaaaaacttcaaagaagtactgcattatggagaaatgctctataaggggttcctttccttaaattcctccatttaaaaaaaacagtctggagtgagggggaagaagtcccagcagggcacagtggcttcccgcctataatcccagcactgtgggaggccgaggcaggtgaattgcctgagcttaccaatttgagaacagcttgggcaacacggcaaaaaccctgtctctacccaaaataaaaaaattagctggacatggtggcatgtacttgtacttccagctaccagggaggctgaagtgggaggactgcttgagcctgggaagcagaggttgcagggagctgagattgtgccactgcactccagcctgggtgacagagccagaccttgtaacaacaacaaaaacaacaacaacaacaacactcccaagatttctctccatgattacactactaacagttaagaaaaacactgaatttccatttggtgatggtgtgacatttcttgttagcataatttgtacctggctattctcatcacaacaaatccaaaagccaagccctggacaattcacttgaagtgttatctgttccaacggaaaaaatgaacagtccctgaagcctgccataacaggatttgacttacagtgatagaacacaaacacaaagacaacaaagcaaagacatgaagagacagcaactgtacttctcattaaaattagttttaaattttcatgtgaaaaaaacagcaagagttggcagagaataccttcatttttccgggatttcaccagtgtgactttagtaggtttagcaggctggctggaagccactgaccgcctgtctgaccgcggggacaagctcctctctctacttgcacttctatccctcggccaaatcttctcactccttctgttaaccacaccactccggccacttcttggatcatgtatttcctcatcataactatcttcttcattatcagatactggttcaggatcaggacgacttactggtatttgaactttcttcttccttctaattgtctgcaagttaaaaaggttaaaaaataagttgactgattttcatatatgtacgttcagttccaaagagaaaggaatattacacttctcatcccatattaactatgaaccagcaagaaacaatacacaaacaactacaacaaatttctaaggaatacatttccataaaggctgtgttttctgttctcctgataaacagatctggttaagcacaaataagaacgagtgggcctaaaaacctctttatttacttcacacagaaagatcttcctggtgtaataatcacaagcttacagggaaactaacaactgttggtggtttgaataaaaaggacagcactgtactctaatgccatcaaatatactctaggtgctaccaaaaccacagcaaacttccatgcccaacttgcttccttaaaaattttagaatgcatcaatatcaaagcccacaattgccccagacctctaagagataatttattctatagccgcactaacattcaataatatgttggagctaattaactcagccgtacttcaccaacacaaactgctttcagtctctggatctcttcaatttgtactcccagtctaggtgcaaattcttccctctggcgttcttttctcaatgattctggtaactggctctgtattgcctgtccacttatttccttcattctctgcaagctgacgatctacatgtattacacctgctgactgaatggccctgtaatctgtggactacactttgccttctcacaatagtatacacttgacctcactgtagttctacaggatctccttgtgtatcactccttgtcttctatgtcggacaccttgagctactgaaacttttcactatcttatttccaattccttcatcttagttcatcagttccatcctggtttcactcgcattccccctaagtttgcatgagacatcctgttgccatatttaaatgactttttcttgacccctcaatcatctgccctgacaaactccagtcctattattaccttcacttccacactttgctgatgaggccctctgtaaattcattttacagaagtcttgctcttgttcagcaatcctttcatctacatattgttgcctctctgtggaattcgctaatgtaggtattctacaaccattcttcaagatcccagccactcagcctgctttaagatcagtgccattttactccccctcccctcctaaattttttcagtatttcccctcctaaattttttcagtgtctcatttatttggtcctctttccttctggtctcaaagaccaaggcaatcttctccctggatgaacaaaacccttgtatttgagctctcattctcatccctacctacctctaagacttttttcttcatcaattaccatactccaggttacctgaaacttcaatctctttatttacctaaaatctgtcctctacctactaagctcccccaattaatcttctatttctctgtcttgctattcacctgcatgttatcatcttttctctcttctctatgtgcctaaacttcttcaaagggctgctctacacttaatactactgcttcctatgactactactattattatcagatactggttcaggatcaggatgagggcctgagcagagggccattctgaggaaacaacgctgaagctcaaggatgagaaacagcagaggccagcatgtgaaaaggaggacagccaatgccctgttatgaactgaaagagaaaggctgcccttctcctattggagcaacccacagctgaagtccttatagggtaatattttctgtaaagcattcctaatgctagctgcctgcttttacatctcacttctatttaatttccaacatattatattggaagcaatacctggtattagtattttaatcttcagttcctccctagtaataaacaaaaacaaagttgagcagatgagcactcaaggctttccctatcattcctgtaagagtgcgccacctctttgggatcctactgtacctgacctatcaacctgagatgacgtgcattatatggttatcagtatgtatacctatccagcccactaagatttgagttttttgagaagttccttaccatgcatttaactgtacatataatgcaatgcttgcatctagtaggtgcttaacttattgaaaggtaaccagtcctattgtgattctctacttatgaatcaacagttataaacatgaataataattagtaggtgtgacaactatgctcgattttaacactatgaaaaatttggaatcaaaatatttaggaaaaaaaatgcctacttcaaaatagtttagcttaactaagtctcaaaggtaaaataaaacaaaatgatgccatgtaagtactagaaaaaaatacaacagagaggcttttgcaattaaaaggcttttggaagcatgacaccaaggcagaaccaataaaatgaaagtctgacagacatgacaaaataaaaatgaaaacatttcaatgttgtaataaaatgatacaaaacaacaaacacaaacaacttacaagcattcacaaaagcaaagaggataacaacacatgaggtatgtatgacaaaaggctaataatctgactacagaaaacactctagtatgaccatcaccaccatataaatgcaaaggacatgaacaggtaaatgaaaaaacaaatgggtagtaaatacaccatgagaggatcaaatccacttgtgatttaaaatgtttcatttgaaacacttgtttagtttatcagtttggcaaagatttaagacctgttgaaaactgaactctcaatagcctattgattttctgaaggacaaactggcaatacatacatcaaaagtcattcaggccctttgactctgaaaagtcactcctagaaaattattctaaacattaactaaacaagtaggtagtaatatgatgatttttgcagctgaattttaaaaaaatacttgcggactggacactgaaatgcctgtgaatgagtgggttggataaatatatatgcatagtgaaatgctgcatggccatgtggatacctacacagtcatgcaccatgtaaaacaacggacagcacgtactgcaggggccccataatatcacaatggagctgaaaatctcctatcacctagggacgccacagggtcataatgtcgtgggtgcactgcagtacttatgttggtggtgatgctggtgtaaacaaagctactatgctgccagtggaatagaagtgtagcagatacaatatgtacagaatataatacttgataatgactatgttactggtttatgtatttactatgctaaactttttatcattactgcagagtgtactccctctacttatttttttttctacatgttaactgagaaaacagcctcaggtaggtccttcaggaggtgttccacaagaaggcattattgtcacaggagatgatggctccatgcgtgttactgcccctgaagacctcccactaggacaaactgtggaggtggaagacagtgacactgatgaccctgatcctgggtagccctaggctaatgtgtgtgcttgtgtcttagtttttactaaaaaagtttaaaaagtgaaaaataaaaaattttaggctaggtgcagtgcctcctacctgtaatcccagaactttgggaggcggaggcaggcagatcacttgaggcccggagttcaataccagcctggctaacatggcaaaaccccatctctactaaaaatacaaaatacgggcttggtagcggtcgcctgtaatcccaaggctgaagcacgagaatcacctggaccagggaggcggaggttgcggtgagccaagatcacgctactgcactctagcctgggtgacagagcgaaaccgtgtcttaaaaaaacacagcctgtaatccaagcactttgggaggccgaggcggggcggatcacgagacagcctccatcaggagatcgacaccatcctggctaacatggtgaaaccctgtctccactaaaaatacaaaaaaattagctctggtggcgggtgcctgtagtcccagctactcgggacgctgagcttgcagtgagccaagatcgcgccactgcactccagcctgggtgacagagtgagactctgtctcaaaaaaaaaaaagaaaaaaaccaaaaagaacccaaaaaattttaaatatttttgtacagctgtacaacgtgtttgttattacgagagtcaaaaagttagaaagtttataggttaaaaaagtttcagtaagctaaggtttattattgaagaaagaagacttaaataaattttataaatttataaaatattaaatacattaaaaatattaaaacgttaaaaatttagtgcagcctaaatgtacagtgtttacaaagtctacagtagtgtacagtaatgtcctaagatgtcacattcactcaccactcactcgctgactcactcagagcaacttccagtcctgcaagctccattcatagtaagtgcactaaacaggcatataatttttttatccactatatatttttactgtactttttccatgtttagacatacacatacttaccattgttttacagctgcctacagtatccagaacagtaacataatatatctattatgagaagtgaattatcaggcaattctgtctttgtgtgaacatcacagaacgttatcttcccaaacccagatggtatagcctactacacatctaggctacttggcatagcctattgctcctcggttacaagcctgtacagcatgttagtgaactgaatactgtaagcgactgtaacacaatggtaactatgtgtgtatctaaacacggtaaaggtaaatacagtactataatcttatggaaccactgtcagatatgtggtctgttgttgaccaaaacattgtcatgtagcatgtgactgtagaggaggaaaagaggaggaaacattaagccaaaaagaggtaactatttggccgggcgtggtggctcatgcttgtaatcccagcactttgggaggccgaggcaggcagatcacgaggtcaggagatcgagaccatcctggctaacacggtgaaaccctgtctctactaaaaatacaaataattagccgggcgtggtgtcaagcgcctgtagtcccagctactcaggaggctgaggcaggagaatggtgtgaacctaggaggcggagtttgcagtgagccgagaccgtaccactgcactccagcttgggcgacagagcgagactccgtctcaaaaaaaaaaaaaaaaggtaactatttaactgtcccctttcctttttcaattgaaaaaaatcctggtatctaaactgagaaaatacacgtaccagtgacataccacaccagtgttagaagaaacactcaagtgtaaacaaataactttggaactattgtttcagttttccttaaatgggaaggataaattcaaataccagaaatgtatcaacaataaagttggggtacctttactaaattacagagaaaagatacttacaatttttgcatttttcccacttttccttagttgctgaacagcaaaagcatgttcaacattatccattgaaactccgttaaccattgcaactcggtcattttccctaaggggaaaagggcacaaaataatatgttagagaaaaacattctggtaagtttatgatgatatttccaagataggtacttctaaaatgtaatctaattatgagccaattaattaatttctcttcagatcaatgataaaataatgtcaactgacttactttcagatttctctgcagaatgtttaacaagtaactaaccacaggtccttaatttttttaagtcattaacaaagtatttccccaaaagactgaacagatatcacatacacgaaatgattcttggtagtacagttacagggcattaaatgatactaagtcatacagctggaaaacttactcccttttaagtttttcatcttttaattctcttttaattcttctaattatagtgccactattttgctagtgtattttgtgtttctctttatcttactaatcttcatagggaataaaaagggtggcaagacttggggaggaggcttctgaaggctagattctacccaaaaggagttatacattttctttttcactatttttacagttacacattctatttaaagtgagtgatactagctttccaattttcatagggataaagcttcctttattttctttggagacagggtctcgctctgtcacttgggctggagtacagtggtgcaatcatggctcattgcagcctcagattcttaagttcaagggattctcctgcctcagcctcccaagtagctgggactgcaggcacaagccaccatgcccagctgatttttaaacttcttttgtagagatggggatctcactgcattgcccaggctggtctcaaactcctggtctcaagtgatccccctgcctcagcctcccaaagtgctaggattacaggagtgagccaccacacctagccagtttccctcttaatatatgttaatttaaggaaaaatatatgaagcatggcacaggtggagtgtgaatatgacaaaatcactaagacagtgtaagacagtacgccagtgcctgaggagaggaacactgcttgttgcacagtgcccacgataagcagcactcttactgtagctgtccttcagctggtcctcctttcagcacatctgaaatcactattgacgtttccccactctgaaaatgaggattatctcgtccaccagatattgcaattccaaatccaaatccaggagcctaaagtaaaaattacagtaaaatattgctattaaggacaaaaataattgttatatcatactctacaatctagagaagccaaaatataaaaattacaatcttaatatatctgtgatccataaacactcacctgcatggttacctattagaattatccttgtacaagaatgcatgctctaataactactggacataacagaatattaaaaatcgccaactatatacatgttctttaaaaaccaaaagacaattaaaaattattaacactgagatcctgactttatttttgatcagaagaggtcctgaggagactggcagagcccagtgtgatcatcagccatcctggcaactgatttagaagatgacagacttatccagcatacacaccctttgtcattttacataaatatcaattgctttgaaaatcaagtattagttatttcaacttctttcaacaacttctgccaactcctaaaaatctctgtagaatataatgccttgtgcacactatacaatagaaggtgtacattagccatattgaactaacattgtaaaattacctttttaaaaaactaaattataataagctacacacttctgaaagagccaagaatctttaccacaatgactcaggacaggccggtatagaaaaaattcaaaatattttccaggttgttaaaaaattacctaatctcaaagaaatcactattccctagaaaggatatgaagtacttaagagtagtttaaagagacaatatacattttcttaaggctacagaatcattaagccagaaatgtatgtttttgtataaaactgtacaattcaaactgcctgaggacaaaggtaacaacttcctccctcagctttccagtccgcaacagaggagactattttcaccatgaatagtgcatacatcacctttcctcccatcccaaagcctatagaagtagcaaaagaaaaaaaaaaatcttcttaaaaatgaataaataccaactattccaagtgtccatcaactgatgaatggataaaacgtgatatatatccatacaatgaaacattgtgtgtaaaaaggaatgaagtactcatacatagtataacatgaatcaaccttgaaaacatcatgctaaggtgaagaaaccagtcacaaaggttaatagattctattattccgtttatataaaatgctcagaaaggcaaatctataaagacaaaaacctgaatggtggttgtctagggctacagggattggagggggtgataattcaatgggaggtgttttttttttccccagtaatgaaaatgttttaaaatggactctggtgatggtcacacaactcggaacacgctaaaaaccaatgaactgcatactttaattgtttggcatgtgaattatatggcaataaagcgaacacaaaaaagttaatatgaaaaaagaaaataataaaacagggaaatttctgagtaactgaagataatggcaaccatctgaatctgtttctctatatattctcccaaaatttaatagaacaaaaatagaccaactacagtggttctcccttatcctcggtttcatgttctttgctttcagttacttcaggtcaactgcagtgtgaaaattttaaacggaaaacttcagaaataaacaattggtaagacttaaattgcacaccgttatgagcagtgtgatgaaatattttgccatcctgctacgtcccatctaagatgtgaatcatccctttgtccagtgtctccacgccataggggctccccacccattagttactcagtagctgtcagttatgagatcaactgtggagaggtaacacaatgcttgtgttcaagtcacccttattttacttaatcatgaccccaaagtacagtagtagtgatgctggcaattcggtataccaaagaaaatctgtagtgtttccttcaagagagaaggcgaaagtcctccatttaatacagaaaaaaaaaaaaaaatatgctgaggttactaagatctacagggagaaggaatcttctattagtgaaattgtgaaggaaaacaaaatttgtgctggttttgctgtcacacctaaaattgcaagggtttcgccacagtgcatggtaagtgcttatttaagatggaaaaggcattaaacttgtgagtggaagacaggcacagaaatgtgctccaattaacagcaaaactgggtttgatactatccaagaattcaggcatccactgggggaacatacaccccatggctcagaggggactactgtacacaaaaccatacactcatcataattcaaagacaatatccaaatttcaaattaaaagcaggactaaaacttcaaaaataaacaattagagacaaatgactattagaacagcattagaaaacataagacactacagaacaaattcaaataaatttgaaaacctaaaggaaacataattcctgaggaaatatagatggccaaaattgaccctattataaataaaaggcttaaacggcccaatttctggagaaaaaagcagcaaaatttatgagggaattatcccacaaaaaggcaccaggcgcaaatgatttcccagagaaattgtgccaaaacatgcaatatccagacagcctcagtacaatatattgtttcagaacactgatatcaaggaaagcttctaaattctttttatgaagcaagtataatactgacactgaaagctgatgactgtccatgataatgactaaccccccaatattacagctcaacataatttatttgtatcagtgcaaaatacaaaataaaaataagcaaacaaaggccaacactacataaatactccatgaaaaagggattaattccaggaatgcaggattagtaggaaatccactggcataatatatcctattaataaatctagagaaaaaaattatatgattatctccaagatcctgaaaaagcctttgacaaaatttgactttcaccgctgaagagaaaacaaagtttgtgaaaaggcactgtaacaaaccctgtaagtatgttgctttttgttaaagtacacaaagaaaatccagcttttcatacacagatacagtcattgaaaaagaagagttattttagtagcctttttaggtaattacgaaaattcatgtttgactttatgccaaaaacttaataaatgatagtttcctaaaggagagtaacaatgtacagtttgaaaccatatcattcaactgtctgtactgttgcatgaattatctattggcctattttacactctgaatgagtattttatccatgtataattttactatagcatgccttagtctttcggaaaatactggttccctgagttaggtaaatcttccaaatgatgccacatttcaccacacagtgtattttaaaatcatgtgttaatatcactatcaaggttatcaaaagagtctttaagtactgaaaagctactgagcttatggtggcagataaaaatttctcaaattttaaattttgttttaaaaatcagttttcattgttagcaacaaatactatcaagaattgttctccttgaagcaaggtactcattcattttggagaaatatgtttgtcaaatattcaagtttggataaccatacattccttcaagtaaacaattgttcaagtaaaagtgatgcctgccttccaccccccccactcaatacacggctgcaattcaaataatcacacaagtactttagtacaaggcagaagtactttaggcacacttcctgtttgcatacctagactactgaaaacgtgtgtattcaagggttggaaagtaacaagacacagttcttactgtttcaagtcattcttaaataaaactgaaattgttcttttaatctacgagtgtgtgacaatgactattatacggtttggtgcccctgccttgatttgggctacaaagcccacagttttaaccgccattgtttctgaaccttcagtcaaataattacacagcgaagaagataagaaataccttcatattgaataaaaagagttttgcccttgaacctaaaaaggtttcagggacctttaggagtccacagaccatactttgaaaatgtcgatattaagaactacttaaacatgaagggagaaaaataaataaataaataaaacaatgaaacaatttacaaaagatatatgagatgttaaaacccacagataaatgcaaattaaaaccaaagaacaccaagaacagaaacattaaagtataacatatttcagaaaagggaggctatagcaaacagtctactactgatgggcacacaaattgctacaactttcaggagaggaatttggcagtaacctaacaaaactacaaatgtactattcttttgacagagcaaactaacttctagaaagtaccctaaagatacacatacctctctcacaatacaaaagtaacaaacgcacaaggttattcattgcagactgtttgtaattgcaaaatgctgggaaaacacctaaacaccccagccttagtaaacgattatcctttccctttttttctccttcaaagaagttggggctaatctttgtaatttagtaatttgaaaaattactctatgtaattttacagtatgaacttacatcttgtttggtagttattttattttcctcttttatttaaaagttaaaaacataaaaagattaaaaaaaaccaaaaacattaggaactttcaataagcaaggcagggatgcgagcatacatttaaaaaaattacttgtgagcaagtaaatgcagttccggcacctagtagggcaggtaatcctgctacatcagtgcttaccacagttcacttaatgactatccaggagccctgcgacttcttacccaggctgcaggtaagaatcacttgggaacaatttcaaaactgcttgctgatgcatgatcctcaatctataccaattaagtaaaaatggagaagaggagttggtggacttaaaaaaaaaaaaatagcccccaggtgattctaatgagcagccaggaacgagagctgcagctttcaatgttttctgaatataagatcagttcattaaaaatttcaaaaggttcaacttttccccactttcccttccctctaccttcataattgtcttatttggccctttcaacagatttctcacctccactgcactacaagtgttggcagtgctgtccctctaacacaaagaccctaatccaatagatccttgccccaagtccaaattccttagcatgcagtgcctttgaatacaactccaaacttgcttcccagcaccccagtctttgctctaaacccacctaaatactgattcctgcttagggagatcatgcaatatcaaactatggcttaacatctcctctctccctaggatttccttactaccttatcaatcttgcaagcttcagctcatctttcaaaacccaggttccatgtcacctcattcataaaactacccttggctttcacagaagtggtccatcctgtacatgtgctggggcacatgtacacacttgtgctacttaacacacagcacaagtagcctcggttagcaaggccctatttgggaggaagtcacatatttaaaatcgaaggctaacctgattaagcccgccaaacttaacctgtctttttcatcgcttacttctagttgatctattttaaactccccactagcaagtcacatagcaaatctcccacgaacttccttacagataacttccgaatgtgggtcactacagtaacggttgcttaaagttatttccaggaaccagttggcagctcttgtccacttcaagctgattaagaccaccgaaccttcaactgggcctgcatgaatgcccaaagagaggtgactgtttgatgtcagagggccaaaacctccttcctcagatcatggtgatactgccatttttcaaacatgcattctatgaagagctgtgtaacttgactacatgtatgcagatcctaactaactcacttttccttacccccaatctttctcccccacaccttggagaaccttggtactctattccaaaaacatccttaaaatcccatctttggagaggtgggtttgagatttgttctcccatctcctcatttggcagtcttgtgagtaaaatcttttctctttgccaaaacaagtcatcgcagtgactggcttgctagttcaatatattcgtatacatctttcaactcaatgcaaccctgcagaagcctgacacaaagtggttcacgaagttagtgaacctcaacaagtatttgattgattattcaatttaactttaattctatttccctttatagagactctttttttaaactagccctaattagagcactaaaaacagaattctggaaaaattagcagcaatgagagtaggcatgaatgaatcttcctgaataaaaacaggcagtcgactacataacaaaccaagaatccaagtgcaacatttacaacaaaactagggggtcaatgtatcccccttgaagtgcaaaatgcaacgaggaggggataaacaaccagctatggagacttccttagcatgtgaacgaagccatattctaaaacaaacaaacaaacaaacaaacaaaatcctccccgccacctcccgaaggaaaaaaaaaaaaaccaccacaaattacaggcaaaaatgagaaaaaacgatcagaatcaaaccctctataccagcagtcctcaacctctttggcaccagggattggtttctttgaagacaatttttccacagaccggcaggtggaggggatggtttcgggacaatccaagtacattacatttattgtgtactttatttctattatgattacactgtaatatatgatgaaataatcacaaaactcaccatattgtagaatcagtgggagccctgagctagttttcctgcaactagatggtcccatctgggggtgatgggagacagtgacagatcatcaggcattagattctcataaggagtgtgcaacctagatcccttgcatgcatggctcacaacagggttcacactcctgtgagaatgtgatgccgccacaggaggcagcgctcaggcagtaatgagagcaatggggggtggctgcacatacaggtgaagctttgctcacttgcccgccactcacctcctgctgtgtggctcagttcctaacaggccaaagatccgtacatctctgtggcctgggggatggagacctccgctctacataaagttactatataatggatactgagtagcagaataacatctctgcagacaataaaagtatgcctgaaagaaggcttaaaagagggagaggattaaaactgttattagcacaagaagatacaagacatgaaagaattagaaaaaatgtagaaatgaagaggaagaattcgagaccaaatctgaaattttaaaaggtcattttagataggaatataagaccaaaaaacatcttaagagaaaaagtaaaaaagaaatcaacctaacatcctaacattaaatcaacaatacatacgacattaacaacattacatacattaacaacctaacatcacaacaaaaagaactataggaacaagagcaaaccaactccagagctagcagaagacaaaaaataacaaaaagagctgaactgaaggagccaggcacgaaacaccattcaaaagaccaacgaattcaggaattgtatttttgaaaaaaaatcagtaagataaactattagctagacaaagaagagagaagatccaaataaacacaattaggacaaaggggataccactgaccccacaggaatacaagtaaccatcagagaatactatgaacacagccatgcacacaaactagaaaatctagaagaaactgataaattcctggacaaacccaccctcccaagactgaaccaggagaaactgaatctctgaacataccagtaacaaacgccgaaagtgaatcagtagtaaatagcctaccaactaaaaaaaaccccaggaccaaatgaattaatagctgctctacatgtacaaacaagagctggaacaatttctactgaaactattcccaaaaactgaagaggaggaacaataccccaactcattctatgaggtcagcatcatcctgagaccaaaacctggcaaagacacaaaaaacaaaacttcaggcaaattatctttgatacacattgatgcaaaaatcctcaacaaaatactagcaagctgaatccagcagcatattaaaaagctaatccaccacaatcaagtaggctttatccctgggatgcaaggttggttcaacatatgcaaatcattaaatgtgattcattacataaacagaactaaagacaaaaaccacgtgattatcttaatagatgcagaaatggctttcaataaacttcaactcccttcatcttaagaactctcaataaactaggcattgaaattgaaggaacacacctcaaaatagtaagagctgtatatgacaaacctacagccaacatcatactgaatgggcaaaagctggaagcattctccttgagaaccagcacaagacaaggatgccctctctcatcactcctattcaacacagtactggaagtcctggccagagcaattaggtaagagaaagaaataaagggcatccgaataggaagagagaaagttaaactaccctgtttgcagatgacatgattctgtatctagaaaacctcatggtctcagtgcaaaagctccttaagctgataaaataacttcagcagagtttcaggatacaaaatcaatatacaaaaaccactagcattcttataaaccaacaacagccaagagccaaatcaggaatgcaattcatatggaaccaaaaaagagctcaaaaagccaagacaatcctaagcaaaaagaacaaagctggaggcattaggttacccagcttcaaactaaactacagggctacagtaaccaaacagcatggtactgtaacaaagacagacacacagaccaacggaacgtaacagggagcccagaaataaggccacacatacgaccatctgatcttcgacaaagctgacaaaaacaagcaatggggaaaggattccttattcaataaatggtgctgggataactggctagccatatgcagaagattgaaactggaacccttccttataccatacatagaaatcaactcaaaatggatgaaagacatcaatgtaaaacccaaaactataaaaaccctggaagacaactcaggcaataccattctggacataggaactggcaaagattgcatgacaaagatgccaaaagcaactgcaacaaaagcaaaaattgacaaatggaatctaattaaactaaagagcttctgcacagcaaaagaaaccatcaaaagagtaaacagacaacctacagaatatgagaaaacatctgcaaactatgcatctgacaaaggtctaatatccatcatctatacacaattttacaagaaaaaaaacaacccccattagaaagtgggcaaaggacaagaacagacacttttcaaaaaaaaaaaaaaaaaaacacgttgccaataatcatatgaaaaaatgctcaacatcagtaatcatcagagaaatgcaaactgaaaccacaatgagcggccgggcgtggtggctcactcctgtaataccagcactttgggaggctgaggctggtggattacctgaggtcagaagttcgaggccagcctgactaacatggggaagccccatctctactaaaagtacaaaaattagccaggcgtggtggtgcatgcctgtaatcccagctattcaggaggctgaggcaggagaatcgtttgaacccgggaggcagaggttgcagtgagccaagattgtgccactgcactccagcctgggcaaaaagagcaaaactccatctcaaagaaacaaacaaaaacacaaagatatcatctcacacctgtcagaatggctaatattaaaaaaagtcaaaaaaaaataacagatgctggcaaggctacagggaaaagggactgcttatacacgttggggaaggcagtatggcagttcctcagagctaaaaagaaaactaccattcgagccagcaatcccattactgggtatatacccaaaggaatataaatcattctatcataaagacacatgcacgtatatgttcactgcagcactattcgcaatagctaaaatgtggaatcaacctaaatgcccatcaacgaaagactagatgaagtaaatgtagtataactatgcagccataaaaaagaataagatcatgtcctttgcaagaacacgggtggaatgggaggccatcatccttagcaaactaacacaggaacagaaaaccaaacactgcatgttctcacttataagcgggagctaaattatgagaacacatggacacagaggcaacacactggggactaccggagggtggagggtaggaggtgggagaggagcagagaaagtaactattcggtactaggcttagtactaggtgacaaaataatctgtacaacaaacccctgtgacacaagtttacctacataacaaatctacacatgtaccctgaacctaaaatgaaagtttttaaataaacaaataacatttttaaaaaaaagaacgccagagattttataaaaaggatttgaggaacattacaaacactaaagacaagcaaaagcagcatgatatatatgaacagtaggagtccctaaagaagcaaatcaaaagaagggaagagaaaaattagtttaaaaaacaaaaaaaacttcgctgatactatttttgaaaaaattgaaactaggtactgaaagagtttacatcactgtaaatatgtgagttatctgagaatatcaactcaggaggactaataccaaaaatatatttaaatgactaaattttaagaaaaaagaaatagcaactcaaggattttttttttcttttgagacagagtttcgctcttctcctccaggctggaatgcaatggcttgatctcggctcactgcaacctctgcctcccgggttcaagtgattctcctgcctcagcctcccaagtagctgggattacaggtgcccaccaccaagcctggctaatttttttttgtatttttagtagagatggggtttcgccgtgttggccaggcttgtctcgaactcctgacctcaggtgatccatccccggcttccaaagtgttgggattacaggcatgagtcaccgtacccagccgagtcaaggattttatattcaacacaactgaccttcaagtacaaaaaacacaaataaaccagtcaacatgcaagaacacaggaaatattgtctttatgatctcatcctaaggaatctaataatattctgacaatcaaaatgacgagatacatggataggactggtgataagcatcacatatatactgtacttatttataacaccaagattaaacgaggattaaagggttaaatgatgtaacagctatatgatctagatatggtaaaaaccattttaaaacagagaaataaatgatagcatgtgcaaaaaaaaatttttactgtttccagtaatcaaagttgacagaggtagattactctgaggcaataatatgctctctgtattagacttactaagagactatcatggtaccttcccaaggggttttcaaaagaaatggaaaatgtgccatttttttctcatctatcttcaacgtaaaaattgtatagttctgccaagacagttgatttttaaaagtatgtttacatgagaaaatgtacaggataacttttagcttctggggatggaagaaagagcatcaaagacttgccgtatttcaaacttttgaaaccttaagcaaccatgagcagcaataacttctgtgtttatatgtctacgcctggctagacaactgaatttatgttagaacttggaaacagggtcctggaattttttcagttatgtgtcctgttttactggacactagccatgcccattcctttacatataattatgactgcttttgcactgaacagttccaacagggaccttgtggtgcacaaagtcaagctatttacaatctggcctttcacacaaaaggtctgcccacccactggttaaagtatttcttggttccttaaaaaaaaattcctgaaagttgctcctgtttcagaaataactgcttaatttattctccaaagattcctctctgttcctattgaatatgcccaattacctacttaaggattccacttgttgccttttattttattcttccatttttccatattaggcttgtacaatccgctaattataactttcctcactaattctagtcttacttttctcctcttattcttcctattaacctttcaatggaatttcaatgaacattcaatggaacctgttctagccatttgttttcacagtggccactgagatcacagaatttgaaaaccagatggagcctcagcaattgtctgttccagctcccttcttacagctgaagtcagcaggcctgggtcctgtgtgtctctatactacttgccaatcatgaccttatggaagacctccacagatttgagttccctcatctgaataagagagattttaatgttatcaactttaatatactttgattccatggggatcccaagagatttaaaggccttttcaaaattagttagtggtaagcccaaacagattagaagtcacaagatccaagcactgcagattttctaccaacttggtagttctcaaaatgctgttcaatcttctatgactgtcagattgattcggttttttaacagttatgtcccttggctagtcaaattgtgtgtgtcttcctgtttattcttactctcattcttttagttctgatacccaaatcatagttttcatttctcattcctgttccattttcttatttccagcttcttacagaatacctccaagtccccttctttaagactgtcattttctctataaaattagcctcaccaccaatgttctaaacaaacattggctcctctattgccaaattacctaccctttattttatttactttattgcatgtatagagagacctttgtttagtttatgtgaattacatgagttcttaatttcagaaattatgttccataaactttttgttttttagagacagggtctcactctgttgcccagaatggagtgcagtggtgcaatcacagctgactgtaacctcaaactcctgggttcaagtgatcctatcgcctcagcctcctgaagtaactgggactacaggtggacacgaccatgcctggctaaattttttgggggtgtgtagagatagggtctcactatgttgcctccactggtcttgaactcctggcctagagtgatgctcctgccttggcctcccaaagtactggaattacaggtgtgagccactgtgccagccacatttaaaaactgtaaattaaacgtgacatataaatggaaagagcactgtatgctgagtccaaacctgggttcaagttctcgctcttaaggggcattttactagacctttctgagacttaccttacttcacatggttaacacctacttcacagacaaatataatgaagggtctgaaaaacttataatgtactaagtacaaacaatagccttctaccagataaagggagtgtatcttagattacatgtttgcttcagcttaaatactttatcagacagcagtttggagctgcttgaccgataaaattccttttatcactttactgatatataattcatatatcataaattcactctttaaagtgtatgattcaatggtttttagtatgtacacagttgtaaccatcactggttacagatggtgccaggacagctggttaaccacatgcaaaataatgaatttggacccctacctcacaacatctacaaaaattaagtttaaagaaccataggtctaagtataagagcttaaactctaaacctctttgaagaaaacacaggaataaatcttcatgacctgagttaggcaacagcttactgaatatgatgtcaaaagtataagcaacaaaagagaaaacacatacattggaccccatcaaaattttataacattttcaccaccctaaaaagaaactccgcattctttagccatcatctctcaatcccctagcctcatcaaccactaatataactctctattcacctattctgaatacttcttataaatggaatcacataatatatgttcttttatgactggcatctttcagttagcataatgttttcaaggttcatcaatgttgtggcatgtatcagtacttcatttctttttattgctaaataatattccattctatgtatatatcatgtttattcattattcatcagctaatatagccagatctattatgaataatggtgccattaacactcatgtgtaacttattatgtagacatttgctttcatttctcttgggtgtatacctatgagaggaattgctatgtcccataataattctatgaggaattctcaaactgttttctacagcagctgcaccattttacagtcctatcagcaatgtacaaaggttttaatttctccacatccttgccaacctttattgtctttctgagtacagccatcctagtgggtgtgaaggggtatttcactatactttttgatatacatttccttgaaggctaatgatactgaacatcttttcatgcatttattgcacattcatacatcttctttgaggaagtatctattcaaatcatttgctatttttcaactgatttgtctttttattgttcagttataaaagttctttatatattctagaaacaaatcccttatcagatgtatgatttgcaagtatcttttcccattctgtggaatatcttctcactttcttgatggtgtcctttgaagcacaaaagtttctaattttgatggggtccaatgtatctgttttcccttttgttgcttatacttttgacatcatatccaataaaccattgcctaacccaggtcacgaataattatccctgtgttttcttcaaagaggtttagagtttaagctcttatacttacacctatggttcatttaaacttaatttttgtaaatcttgtgaggtaggggtccaaattcattattttgcatgtggttaaccagctgtcctgggtctgttaatgactgttcttccctccagtgcattgccttggcaccccatcccaagtttacctcttatgcaatcacctccctagtttaaacactcactggctcacccttaaaattacctgactagtttccttgctttctatactcatcttttaatactttagtatacaaatatttaatcttttacataattctattttagaaaatgaaaaagcagagtaacgacgagcaactcattcctgaggaattcacttcatttcccaaagaattagaaaaatgtatgcattttctaagggcgagtatctgaaaactaaaaaggtgtgggtgtgttacagcagcaggagaggtgaacacatgtggttaccatctgaagctacacacctacactaatacgataagcatcagacttgtgactattaagcacttcaaaaatggctagtgttacctgaaaggtgctgacattgaaaagtgaacaattttgtaagatcaactcatcaatttttaaacttatcacatgttgaaatatattttgtgcatactaaataagacctattataaagttagtttcacctgtttttctttttttttacagtttttaataagaagactaaaaaatttaaatttacatatgtggtttatattatactgctactgggcggtgctgttgtagacctcccaagagtgactttattcgacatggttagtgtcctagggaattaagttttttggggcagaactaggtaccaagcactaaggagatagaaaacggacttaagatttccaacccttgtgaaagttataatgtagtaggagatggggtaaacaactatctgatgtacatattcaactgtcactgaggaccagtagagagatcagaatccatgaggaggcaaattctgcctgtttttttctgatataattccagggcccacaagagtacaacagtgcttggcatacagtagaacactaaaaaattacttagtctttaagaatgaatagggtttcaatggtttctagaaatataagatgaagaaaatatcttctggaaatacaaatgaaagaatgaagcatatattattctagacagtaaatagcagaaaatgttaggttctcatcaattaaatggcttttttataacattacctccaactttcataaaattgactgtcagatgtcaaagaatatggatttgtctttatttggcaatacagagtatctatactccaggttattgccaaaagaatacagtttcaaattatccccttcacttactaccactgccaaaagcccacttgctcacctcagagagaacaagctttctgattcctctgtgtttcttaaaagtgggatgccagaggccatagccctccatttcaaactgaagcctatttaaaatacgtgttagggatcccagcccagacaaactgagtaagaatctctgatgggcagggactgtgcagttgatccctctttacaataaaacctggagagccactgctctaatcagcagtcagcacactatggcccacagttggaatacagccacattcgtttgcctgttgtctatggttgcttctacaatacggctgcagggttgagtagttttgacagagatttatggtctgcaaagcctaaaatacttatttactatctggctctttatataaatactttgctgatcctgctctagatagtctaaattttattcggcatcatcttagaacaccaaacaactaagacagttgaaagtaccattctgtagcctcagagaatgaagtcaattaagttatgctttggcataactcagctcccactggcaagactttttcattgtccaaagattttaaaaatgtttttatttttaattattatagtaaacagtagttgtatatatttatgggatccacatcatacattttgatacaagtataatgtgtaacgattaaatcagggtaactgggatattcataacctcaagtatttatcatttctttgctgttacgaacatttcaattccactcttctagttactgtgaaatacacaataaattaacgatagttgccctattgtgctactaaacactgtatcttactccttctaaccatatttttgcacccattaaccaagtcttccatccctacttccctaccacccttcccggtctctggtaaccatcattctactctctgtctccgtgagttcatttttctttttttttttttttttagttcccacgagtgagaaaatgtggtattcgtctttctgtgcctggcttatttcatttaacgtaatgtcctccagtctcatttatgttgttgcaaatgacaggatttcattattttttatggttgactaatattccatggaacatatttacattttctttatcccttcatcaactgatgtacacttatgttgatactataacttggctatcacgaataatgctgcaataaacatgggagtgcagttatccctttgatatactcgtttcctttttttttggacggagtctcactctgtcaccaggctggagtgcaatggcgcgatttcggctcactgcaatctctgcctcccgggttgaagcaattcccctgcctcagcctcctgagtatctgggactacaggtgcacaccaccacatttggctaattttttgtattttagtagagacgggatttctccattttggtcaggctgatcttgaattcctgacctcaggtgatccgctcaccttgccctcccaaagtgctgggattacaggcatgagccaccgcacccaggcctttctttgggatatatactcagcagtggaaatgctggatcatatggttgctctattttcagtttttgaggagcctccataatattctttttttttttttttttttttttttgagacagagtctggcactgttgcccaggttggagtgcagtgcagcaatctaggctcactccaagctccacctcccaggttcacgccattctcctgcctcagcctcgcgagtagctgggactacaggcgcccaccaccacgctcggctggtttcaccgtgttagccaggatggtctcgatgtcctgacttcatgacccacccacctcggcctcccaaagtgctgggattacaggcgtgagccaccatgcccggcctccatgctattcttcatagtgactgtactggtttacattcctatcaacaacgtataagagttctcttttttctgcctgctcactagcatttgttattgcctgtctttttgataaaagccattttaactgggatgaaatatttcattatactttcgattagtatttatctgattagtgatgttgaccattttttcatatacctgttgaccatttacccatatgtcttcctgagaaacatctattcagctcttgtgcttcagatcttttgcccatttttaaattggatttctttttcctatcgagttgtttcagctccttacatattctggttattatctcatcagttgggtagtctgcaaatattttcttcattctgtgggttgtttcttcattttgttgactgtttgttgtgcagcagctttgagcttgatgtgatcccactgtccattttgttgtggttgcctgttctttggaggtcacactcaagaaaccttagcccataccaatgacctttagtgtttcccaatgttttcttctagtagtctcataacttcaggtgcttaatccattttgatttgttttagtatacggcaagaaataggggtccagtttcattcttctgcatgtggatgtccagtcttcccagcaccatttattgcagactgtcctttccccaatgttcttagtggctttgttgaaaatgagttggaggtaaatgtgtggatttttttctgggctctctattctgttccactggtctgtgtctgtttttatgccagcaccatgctatagctctggagtataatttgaagtcacataatgtatgtaatgtgattccttcagttttgttctttttgcccaggattgctttgcctactctgggtctttgtggttccacaaaaattttaggattgtttttccaaccctaaaacataattctgtgaagaatgtcattggtgttttgacaagggttgcaatgaatctgtaaattcctttgggtagtgtggacattttaacaacactgattccaacaatactgaatccatgaccatggagtatctttccactttttggtgccgtcttcaatatctttcatcagtgttttatagttttcattgtagaaatctttcacttctttggttaagtttattcctaggtattttattttattttatttgtagctattggaaataagattattttcttggtttattttctagattgtttgctcttggcatacagaaatgctgctgatttttatatgctgactttgcatcctgcaattttactaaacctcagttctaacagttttctggtagagtccttaggtttttctaaatttaagatactattgtctgcaaacaagggtaatctaaatttttccttccaatttggatgccttttcttttcttctcctgtttaattgctctggctaggacttccagtaccacgttgaagaaaggtggtgaaagtgggcttccttgccttcttccagatcttacaggaaaggcttttagattcccccctcatgatactagctgtgggtttatctgtctgtggcttttattgtgttgaggcatgttccttctacatccagttgagtttttatcatgaagggatgctgaattttactgaatacttttttggcatctatagaaatggacatatggttatgtccttcattcttttgatgtgatgtatcgcatttacagatctgaatatgtattaggtggttctcacattgctataaagaaatacctgagactgggcaatttatataaaaaaagagttcattggctcactattctgcaggctgtacagcaagcatgacagcatctgcttggcttctggtgaggcctcaggaaatgcataatcagggcagaaggcaacaggggaacacacatggccagagtaggagagagacagagagcagggaggtttaaacaatcagatctcatgagaactcactaactatatagtagcaaggggagatggggctaaaccattcatgagaactccactcctatgatccaatcacgttccaccaggcccctcctccaacactggggattacaattaaatgtaagatttgggcagggacacaaacacaaaccatatcagagtatgttgaaccatccttgcatccctgggatgaatcccacttgattacaatgaatgatcttttaaatatgtagttgaatttggtttaaggattttgcatctctgttcaaagatactggcctgtagttttctttttttgttgcgtctttgtctggttttggtaccagggaaatactggccctttggaatgaatttggaagtattctcttcttagcttttgtgatataattcttctttaaatgtttggtagagttcagcagtgaagccatcaggtcctgggcttttctttgatgattttctttttttcttttcttttattactgcttgctctgaaaatatttcttttttaattcaaaaaaccaaaaacaaacaaaaaacaaccaaaaaaccattcctggagggatggctggtgaggactttgattttgtcatagtctctctgtgatgaggctcagaggaaacccagctgttttcctagtacaacagttagcatattcaacaactgaagaattgtgagttatatacctctcttatctcaatgtatcttctgatgacattttctgggctgccctctcatggcaaaaaaataactgaggcacagaaagaagccaggtacaaaatggaacctacattaatcatctaaaacggcattatcataacagacttgcctgagccattacttaccacaatgaattggtatgacacttctaacaaggtcagaaaaatcagattctgttttcttaatattgaggatctttcccactttccctgagctaatgagacacaggtctgtggcaaatacatttagtattttcctacacatgaattcctaacaaaaccaagcaagagcatacaaagggaaacatactttagctaatttaaaggtgtcttatgttattttgcttattgaaaaaactgaaaaggtagtaaggaaaagatgtaatgtggtaatagcaaattgcatctgtggtctctaatgaataatctcgcttccagtaaaaaaaactatcaaaagagcttaaactcaaggtaaacaaaaggatgaaaatattaaaataagagcagaaatcaatgaaacagaaaacagaataaagaatgtcactgaaaacaaaagtaggtattttgaaaagatcaataaaattgtcaaacctctagccagactgaccaagaaataagacacaaattaccaatataaataatgaaacaaaacaaaacagcattatagaaccatccaaaattaaaaataagggaatattatgaacaatgttatactcataattttaacaacttacatgataaagacaaatattttgaaagacacaaactaccagtcaggcatggtggctcacgcctgtaatcccagcactttgggaggctgaggtgggaggattgcctgaggtcaggagttcaagaccagcccagccaacctggtgaaacaccggctctactaaaaacacaaaaactagccaggctggtggtgcatgcttacagtcccagctactcgagaggctgaggcaggagaatcgcttcaaccgcagaggttgcagtgagccatgatggtaccactgcactccagcttgggtgatacagcaagactctgtctcaaaaaaaaaaaaaaagactaccaaaaaacaaaacaaaacaaaacaaactgtaacaaggaaaaaatacataacctgaatattcctatataaaattaaagaaactgaatttgtaatgaaaacccttcccacaaagaaaactctagcaccaggtaactctactagtgaattctaacaaatatttaagaaaaaaataaaatcaattgtacatgaactctaccagaaaccacaaaaggaaggaacacgtcccaactccttgttttgaggtacagcttttccatgataccaaaaccagatataaacaatgttaaaaaaaagtactgaccaataaaacaagaatcttcacaaaacatcagcaaatcaatccagcaacatctggaatggataacatgtaaacaatcaagtagaatttatctgaggaatgcaaggctgttcaacaaacaacaagaaatccaccatatcaacagattaagaagaaaacccatataatcccagtcatacacacacaaaaaaaagcactgacaaaaattcaactttcattcatgattaaaaacaaccatctctcagtaaactaagataaaagggaacttcctcaatctaacaaatggcaaaatagaaatacaagggaacttccttaacctgataaaaggcatcaaccaaaaaaaaaaccacttactggtgaaagacagcttttacccagtattaagagtaaggtaagtatgcctgctcaccattcctaattaacaacatcctgaaagtccaaactagtgcaataaggcaagaaaaagaaataaagagcattcaaaaggagggaaaaaaactgcctctatacacagatgacatgactgcctacacataggaaaacacccaggaatctaaacaagaaagttcctacaactagtaattttaagactgcaaggttgctataaaaaaaaaaacaaaaaaaaacctgcatttctacacagtaacaaggaacaatcaaatattgaaatgaaaaaaaaaaaactatttacaatagcgccaagaaacatgagatatttaactataaacctaacaaaaatgtgtgcaggatctatttgccaaaaactacaatacattaaagaaataaaacaatgaggagataacattatattcatagtttggaatattcaatattgttaaaatgttaattatccccaatgatttgtagattcaaatgcaatcccaataaaatcccagcagttttattttctttgagggaaggaagataaaagttgacaaaattattctaaaatttatacagaaaggcaaaggagctagaatagccaaaataattttaaaaagtatttggaggatttgccctacctgatttccacgtttaatataaagctacagtaatcgatgcataagtaactggtaaaaaggcagacacacagatcaacagaccagacaagggagtccagaaatatatggtcaattgatttttgacaaagcgagaaaggcaattaaacggacaaagtataatctttcaaacaaaatgcttcttcaaaataaacactggacatctgtatgaaaaaaaaaaaatctctctgcccgtatctcatggcacaaacagaatttaactgaaataaaacttttaaaggaaaacagaggaaaaattattcttgattttgggtttggcaaagatttctgagatacaaaaccaaaaacatgattgataaaggcaaaaattaacaaactggactttatcaaaaatttttctttctttccttttgagacagagtcttactctgtctcccatgctggagtgcagtggcacgatgtcagggtcattgcaacctctgcctcctgggctcaagcgattctcctgcctcagcctcccgagtagctgggactacaggcacatgccaacactcccagctaatttttgtatttttagtagagacaggctttcaccatgttggccaggctggtctcaaattcctggcctcaagtaatttgtctgccttggcctaccaaagtgttgggtttacaggcttgagccactacacctggccagagctttatcaaaacttaaagcatgtactgcaaaagacactgtcattaagagaaagaaaaggcaaatcacagaatgggaaaaaaatacttacaaaataatacctgataaagaatctgtatcctgaatacgttaaaaaaaaaaaaaaaaaatctcaaaactcagtaacttctgtgtaccaaaaagaataatcacagagtaaaaaggcaatccatggaaaggaaaaaaatatttgcaaatcatatatttaacaactggttaatatccaaaatatataaagactactgcaactcaacaactaaaaaacaagcaacatagagcttaaaaatgggcaacagtcttgaatacgtgaagtctatgttgtattttgccgcaattttataaaatctcaataataagaaaaacccaattaaaaatgggcaaaaggtttgaatacattttaccaaagatatatggacaacaaatgagcacatcaagagatcattaatcttcagagataagcaaactaaaaccacgtgtgataccgctagatacccactgaatggcaattggtcttgctctgttgcccaggatggaatgcaatggcgtgatctcggctcattgcaacctccatctactgggttcaagtgattctcctgcctcagcctccaagtagctgggactacaggcgcctgccaccacgtccagctaatttttgtatttttagtagacggggtttcaccacgttggccaggctggtctcaaactcctggcctcgggtaatccaccagcctctccctcccaaagtgctgggattacaggtgtgagccactgtgcccagcgtttttttttttttttcttttctttctaaatctgacaatacggattgagtatcctttacctgaaatgcttgggaccagaaatgtttcagatttcaaatgttttggatttgggaatatttgcgttatacttaccagttcggcacccataatctgaaaatccaaaattcagaatgttccaatgagcatttcctttaaacatgacgtcatcactcgaaaagttttgaattttgcattttagatttcagatctgggatgctcaacccatatcaagtgctgatgaggatacgcaacaacgggagctcttatacactgccagtggtggtgttagatggtacagagaatttgaccatttctttaaaacttaaataattaccatgggacccacagcaagtcttttcctaagtatttacccaaaagaaataaaaagttatgttcatacaaaaacctgtacactagaggtttgttcataatcaatggaaactgcaaaacacaaatataccacaactggagaacgaacacacaattatacattcatacaatgaaatgctactatgcaataagagaaactactgatagagtaacatcatggagaaatcccaaatgcattaggctaagtgtaagaagtcagcctcaaaaggctacatgttgtatgagtccatttacatgacattctagaaaaggcaagaatgtacaaaaagaaaccatatcattggttaagtggacgtgaggggaccgggatgattaaaaataggtgttaagagaaagtttttgtattgaagttgtcttgtattttaattgtggtggttacatgactgtatatgcttgtcaaaactcagaactgtaagggtcaatttcactgtatgtaaattataccaataaaaacaataaaagtcttaataaaaataaatgtaatatgataaaaaaaataccaaatcattgacatcgccactagtcataaggtaagaagttattttatatgtttaatcatatgtatctgatttaaatatgctacctatcaatacatttcaaacaaaggaaggccatgttgcaggtttatgaaagttaaggttagtattagataatgatttccttcaccatttaataatgaaacattaaaaagttgactatatcttatcagaaaaaaaaatttttttttttttttgagagggagtctcgcctctgtcacccaggctggagtgcagtggcatgatctcggctcactgcaagctctgcctcctgggttcacgccattctcccgcctcagcctcccgagtagctgggactacaggcacccgccaccacgcctggctaatttttttgtatttttagtacagacagggtttcaccatgttatccaggatggtctcaatctcctgacctcgtgatctgcctgcctcagcctcccaaagtgctgggattacaggcgtgagccaccacacccagccaaaaacaactattttttaataattaatttacccattatctactatgtgcagatccaaacattcgtgagataatcaggggcagagtccagcaacatgattctttcccctttccatcttcctaataatggatatagctggtagaaatagtaagtgtaaagtgcaaggccagtatttaaatattctctctttccatacattctctaagaaagggagtaatcagtagattcagctctcttgaaagagaggaaagagaattttgagagacacttaactttacaaattggtaaagcatgaactggtgtcaacttgttccattttaaacttgtgaaaaccaaggttttcgaaggtgactgaatcacttccccatttctaaagcaagagaaaggcagaaccagaattcaaattgatagcagtctcacttcggacaaagttcttagtcccaccaagtaagaactcatctcttactactactcatctctcttctcgcatctgcaattgtttaagcaacagcttgggtcaacatgtttgaaatcaattaagtatcttttaggattttattatgcatacaacctggtttaatttcaaacttcactcccacaatggatgcatatatactcagaaaggttgaagcagtttataataatttatactaatgtacagagtcttttatctgatcactcaaaattttaaaagcaaatcactttttaagtcaggaataaaaacagcaaatactcaaaaggatatatgaaaaagtaatcatgctcacttttgaccttaataaaaaattattgtaactctaattttaaacaaaagaatatagaaaaagtttcctcctccctctggcttcctgacatctggctttcctctattgttttcaaagctgccagtatcctgagttatacacagattacttactgcaacacaaacttaccctgtgaagcgtcactgtatgttgttcccatatagctgtttcctccattgctgtgctctgataaaggaaaagaaaaacaaatcatttaccttttaagaaaatgtccttaataaggtgagcaagaacatccaacaattcagcacactgaaataccaaaattcacagttaatattagagacactctgaaaggaccttaataattatggaaagttttttgtttgcttttaagagacaggaaacgacacacaggaacttcctttgtttttaacttaatttggacagctgctctatattcatttcatgcaagctgaaatcagtattcaagctaattctgcaactttatacttagaaaagaataaaagttggagcggtattatcttaaaatatctaatggcacgtaaacatttaaaagcatctcttatgttttacaaacgaagggaaagttaaatgcctctgaacacagtaattataaatatacatgtcacaggaaaacagataaaaccattaataggtttggcaaatggctgctttaacgtcacaaacatgactactctacctagtttcagttttgctacagaattacttctcaagcttcatttataaccaaaagaaaaagaacagcttttctagtatatgtatcacacacgtagatacacacaagaaacaaaaacaaaaaagaacaatctcccaaactcccccaagaatcatcataaaataaaagcagtaagagctccaatacaggtcctgcccaaattatagcgtacttcagttttacctcctgtcatgagcctctcaatagagaggaaaataaattattattttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtacagacggggtttcaccgttttagccgggatggtctcgatctcctgacctcctgatccgcccgcctcggcctcccaaagtgctgggattacaggcgtgagccaccgcgcccggccgaaaataaattattatctaaggcaggggtgtccaatcttttggcttctctgggccacacttgaaagaagaagaattgtcttgggccacacataaaatacactaacactaatgaaagctgatgagcttaaaaaaaaaattacaaaaaaaaaaatctcataatgttgtaagaaaatttacgaatttgtgttgggccgcatgcgacctgtgaaccacgggttggacaaggttgatctaaggaattagcagtaaggaattcaaaataaatttcttttaaatggggttaattgctcttggagacttaaaatatttcagtctctcttaatgttaccattttatgaaactgggactcctaaaatgtatttacaagtaaatttaaaaaagattcttcagagttatcaaaaggtaaagtaaaaagggagaaggctaagcatgacactctcagatcactagtcacccattactataaatgcctatttcataagtgaggtctgttttctcttactgctgtcattagcatcatgagaatatgcctaccaaggtgccatgggcccattctctcctttcccacagcgactttaattgaagattaatgccattttagaaagtaagtccctataaagaaagcctgcttccctaaattcaaagcaactagattatcctgccagatgaataagagaggagagagaaaggatctctctgttcactcccatagataagaactgccaacctcaccagcatttgtttcaatcttccaatgaagtgcaccaaaacctccctttaatgagacctccactggaaacaaagctgtttttttttttttaaacaaacattgaccgggataatgcactaaaaaaaaaaattcttccatcaatgagaagcaacaatagtatgagtaaatcagctaaacatcaacagtcccactaacatacacatgataaaagtatctgcaagagttgccagtttgtccaatctcagctgatattaagaatgagaactgcttgcatagctctcagttcatcttttcttgatctatttcattaaccagtgacattgttttactgcctttttaatctttttcctatcagtccaaatggcaagtgatgtgataacatgcacttaactctctttgataacatactctatggtatgaaacagttcatcatcctctctaaggtcttaatgaacacagttttccattttgtaagaagatgttaatcaaatgggaaaatttatttaacattaaggggggagcaggttgtaaaacagcgtgtacatggttatcctaattttgtttaaacattagtagggaataaaggctcaaaggataaacaaaatgttaacattgtttatcaccttcaaagtaaagggactgtgggtgacatttttctatcaggtgttttatcttcctgctttcctttctccattccccatcagaacaaactggcaatgtattttaaactatattcacaaaatctcattcctatttgacatttcgaatacagacagtccctgacttaggatgggtcaacttgattttctgactttacgatggtacccatacaaccattgtttttcatttccactacagtattcaagaaattatatgagatattcaacactttattgtgaagtaagcttttgtgttagataattttgcccaactatatactaatgtaagtgttctgagcatggttaaggtaggctgggctaagcttatgatactgggtaggttgggtgtattaaatgcatttttgacgtaaagtattttcaacttacgatgagtttaatcaggacattgttctaagtgagctgagaagcatctgtatctgtttttccacttggcttttaggaaaatcaaataatgcttaagaggattaatgttcttattgttaattataaaaaatgtttattctcctgttagtaagcaatctatacattaaggtcttaatgtacagtctccaggaggagtgcaataagagaaacttgctttgtacaagggagaagactaaaatactaaaacataattgctctcaccattccacatcaaaatcaatatagtttttctttggaggactggaaaagtccacatctcaaaaaacttctctgttaaacatcaattatagcttgatttatctgaaggaagacctatgtagaagaaagtaattgagaatgaaacatcaaaagaagtggttaggctcttgaccagccactaaaccaacttaatccataatataagtgagttactatgttttaccactccttatctttaaaaaaaaaaaacaaaaaacagaaaaatatattcctagtttaaatgatggaccatgtcatctctctccattctctagcctttcatttgcttctgtggcaaaagtagcaaattctatccatggttgtttatataaccaggcagtactgatgaggagttctgaatgaggaatggaaggatgaacaaacacgtaaatatgtaataatgcaaatacagtaaaatgataatggtagaatcttagtggttgggattcaggtaaccatggcagactgctttcaatcttgttacgtgtttgaaagtgatcataataaaatgctgaggaaaaactaagaaatccttctagtaaatcactcagaaatcaaagctaaaattgatatgagacatttttagtaccagtaaatttattaaccactattttaatgagcattccataaagaaaaaatgttcactaatgactgagaattttgatgcattagaaaagcaaggggtgtggaggttcctttggaagaatacctaagaaacgcatggcttctggagtggagaaaggaaaaccaggtaggaggagtctcacttttcactgggagccctttgtacttttaattacattcatctattacttatcaaattatttttaaaacttaatatccttattgtaaacttgcttgtcattttctcatttcaaacatgcacaagggataactgcataacttgcacaaaaagcttctggtaaattaccagtctcaggttcaagacatttaggcttgtaggagaccaaggggaaaatgtattactcctctaagcatgattctagcactaccattccctagtaactcagacagatgctggtaaacaggaaatgaactagaccaggcataaggagaccagagccgaaaggtatcatcaactagaaacgtgatcttaattttcctcacctacacaattagggaaatgggtgaaattatctcaaatgaaaagacttttctagctccaaaattctatcagactataattccaatgaacaggctacaaattcaataattagtgaagcactgcaggcatcaaaagtgactgcaattcatggttgctggattctgagttctgcgcacatttctaagtcagcatcaactgactagaatcacaatttctgaagaagcaaaaagctgtatttcacaatctgccaagagtttgtttagtttctttgttctaagctccagctggcaaagacactactcagatcaccaactctgaagggcttcctgccaaaacttcagatcccagttctaggcagtttcactgtccttcaggactgattactgaatggggaaagataggagggcacaataactgaaaagacaggatgagcctataactgggagaagaacaaatccaaaagagaagatataaagtatactccaaatgaagaactccttaacattatctaaatacacagccagttaaattttactaaccttatggctgtaatttcaaaaccaatccatgtatcattcattcattcattcattcaacaaacatgtatcagacatggtaagtgttggggaggccaaaaaaaggtccctctccctccctaggggctcaaagaagcagctgagaacactaaatggtatttaggttggtgcaaaaataactgcagcttttgccattaaaatggcatcaaaagatatgagctttttgcaccaaaataaataacttttgcaccacatagataagagctgttatggaagatgcaaaaggactgtgtctgctgtgaagatcagagatctgttccctgagacagcaacgttttgagttcatcaagcttgaaggatgtccaggaaaaaagtggagaaagatgtttcagaagaaacagcatgtcagcaagattgtgtgatgctacacatgacgctggctttgatatgactaagttgtacaatttatggaacaaggagagagtaaaaggagagaaggtgcaagggtaccagatcacaacaggctttataatataatgccaaggactttaaactcaaatggaagacactaaagaattttcgacgatcaaatgatataagaattcatcctgaaggctgtaatgggaaaatgatttgagaaagggaaaccagttagaaagttagtgagaagtgtgggtggagttcaaaatggctcttgagtagtcaaccaagtagcagtgctgaagtcaaaaggaaaagatgtaattacccaaggactaagataaccctgtggacaaccaaaggaatttgagaagaagcagacaatgaggatacatgaaaaccaatggagctaatacaaaacactacttactgtccagagaatacaccaaagcttaagatccctcaattttttagatcaatacacctcatttatctgacatcataaaataataaaatttccacaaatcttcaaggaacaccctttcttgatgacatgcagttccccattaggaaaaccaatagtaaaggtattaagaacactctgtgaaccctccaagttccttctgtgagcaaagctgctacactgaacggcttctcattccttctgaactccaaagtgtttctgttttggtctttttggcttttttccatccaaattgaaagcaagatcatctatggagatgaggttgagccaggaacttaaggagaaggacaaggtaggtttcagtgaataaaacagatgacccctgcccttcaatgaagtttcaattacataatttcaaattgtgatcactgcaacacaaatgaagtacaaagggaatagtgctacatgttaaaaggtaaggcaaaatatgtatatttggactgatctgatgggccgtcatttaaattcccaaaatagaaatgtccaggaggtagtaaaaaagatcactctaaaataaaatgaagaagggtcctaacgatattcagggattcaacaaacttcatgaatagaagataaaaattcaggaaacataagaattaaaataatgatcaaaataagaaggcagcaaccataggataaaagtctcaatagaaatttagtaaatttagcatccaacaccccactgtattcaacactggttaaatttacaaatgtatcactgtgtccatcccttggttaacagtttaggaaacaaatgatgagatggatatgattaggaaatattagtcggaaagacagacacagtgaacctgtaattttctggttgatcaaagctgaaggtctgctaaaaacattaagttcacagataagctgctacattagctataaagtaagagtgaaagaacatcagcttaaaagttaccattatgtgtacattaaatattgagaaaatctcagtagggacagttacaaatattcttggaaacttaaaatctagagtgctttcaagttatcaaaaataaaactatttttaggtatagcatcttctaaaggttgaagatagatacaaagatctctcacaatttattcaggtagacaggaggaggaagggaatggcatagcagagatgaagagagagtgacagtcctctgagtatatctttttgcataactctctttcttagaccacagtattgtttcatgacattacccttcacagatcaaaaaattaaactattaaaaccaaaaagacatgaggggaggggaggaaatcaaaaacagaataaagacagtaacaaatgaacataactatattacagatggagaatgtaaccacactaaagaagagtttaacttttctataaatctaatattttaaaataaaaagtttaaaaaagttataatggtatagaaaaatgcagaaagataccaattttggaaaaaatatttacgtactcagaaaaaaaacttggtttcagagttgtatattttaagtttttatatatcctacaatgaacacatgaatttcataatccttgaaaactggtaaacatcacatctgaattacgaaacaaaaaatgggcaaaagtggccaggcatggtggctcacacctgtaatcccagcacttttggaggctgaggcaggcagatcatttgaggccagatgttcaagatcagcctggccaacctggtgaaaccccgtctctactaaaaatacaaaaattagccaggcatgggggcacatgcctgtaatcccagctacttgggaggctgaggcacgagaatcacttgaacccaggaggtggagtttgcagtgagccgagattgcaccactgcactccagcctgggtgacacagtgagactgtcttaaaacaaaaacataaacaagaaacagggaaaagtgatctacactgttagaagttgggacagggttacctttgtgtatgaagtaactcgaagggatggaggtgggggagcttcgggacgtaaagtaaatgttcttccttgatctgagttgtgggcaaataggcatattcactttgaaaatatatcaatctgtgtacacctatgatttgcctaatgtattatgttatttaaaaattcaaaataaagtaacctgacagaactgtaagtaatttgactgcaatggattaaaataaatcaaatatgcttccatccatccatatgcccacagtgattttaaaaaatgataagtgctggcagaactcattattttgagaaactggtacgtatagggaaagaataagatatttactctgtctttcctatacaaacagtaccagtgggcgatcaaaatagtagatgaaggagagtttctttttttagaagcactccagctaaccaatgaaaaaggaataataaaaattgaatatcatcattttgtaacacctagtgaattaagggatctacacactgatcatcaatggctgcagacatcatccaaaaacaacagaaaaaaccctgggaccgaatgccacttatgaagtagaactgtaaaaacaaacaaaaaaatcaaatctgaatctgatcaaggctctagatctgtgctatccagtacagtagccaccagccacatggggctactcagcacttaaaatgtgggtagtccaaactgagatatggtatatgtaaaatatatatatgatacgaaatatgtgatatgtattatgatatgctatgtgcaaaatatacatgatatgtaaaatatacatgcaacagtattcagagactgaatatggaaaataatttaaaatatctcacctataattttatatcattgcatgctaaaatggtaatattttggatatgtgtgttaaataaaacatgaaaattaattttaccttaaagttttggtgtggctactacattagacagaattgctctagctacagttaaccaatttacaggaaatacagtgggccaaccaccattgtaatcaccacaaggaagcaaataccaaaattcatactgttaaaatttctacaaataatcctgtttctcaaccaataaagctgcaagggaagaggggaaagagagagacagaaatgggggacctcatatgcctaagagaaatgttaaacaatcacagtaagaggacctcatcaaggaaagttgacatttaacacaattagaaaacactaaacatggctgggcgcggtggctcacacctgtaatctcagcacttgggaggccaacgggggtggatcgcctgaagtcaggagttcgagaccaggctggccaacacggtgaaaccccgtctctactaaaaatacaaaaaattagccaggcatggtggcagatgcctgcaatcccagctactcaggaggctgaggcaggagaatcccttgaaccagggaggcagacgttacagtgagccaaggtcatgccattgcactccagcctgggcaaccaggagcgaaactccgtcttaaaaaaaaaaaaccaaacacttaagtacttgatttggagtttattttaaaagtgtgctaatgataatgtagttatagtacttttaaaaaagacatcttttagagatatatattcagacacatgttgagtattccattctatctcttctctgaaatgcttcaaaccacgtgtttccgatttcagggtgaaccatccaaaatccaaaaatctgaaatctgaaatgctccaaagagaattttctttgagcattatgtcagtgctcaaaaagtactggattttgaagcatttcagatttgggatgttcactatgtactaacagatgaaaagatatctggcatttgcttcaaaataatggggaagagaagacacaatgaatgaagtatagatgaaatgagactggctgtaagttgttaaccatactgggtgacagtaatgtgggaattcattatattccccacatccacttttctataggtttgaaaattttccacttaaaagaaggtaacttgaggggactagaaattaattactgatttaggaaagacccaaaccaagaatgcagctaccatgatgccaggatattaagtagtatttccatgagctggctattccagcaactgcttcccctcccctttcagaatagtaagaaaaatgcaactagtcctggagatggattagtaccttccttctgctgctaagctgaatttaaggtggtctaacattaccagtaagtgagttaacagcattgaaaaggcaactcttgtctagaaggggtaacagatactaatcaaataatagcagagaactaagtacaggttatcataagtgctataaaggggtacacagagtttaaagcacagagttttgacctagtttctgggctctgggcaaagtccttgaggagaagagacagctatgaggtgcatgaaagatggaggtggcaaggtttccgggtagaaaaaacagcacgtgcaagagcctagtgtaggaaagtgcatctctcattcattcaaataatgttttgagagtttcctatgtactagacactgtgttaaactacacgaataactggacacaactagtatgacctttgttctcaaggagcttacagtctagcaggagaaccaaatgatcgaaaaactccatggctaaatatatagtcacaaagttaaataagtactatgaaagaaggaaaaacagtgccatgaggaactcaaagagaaagttgacaggaagtacacttgctaggaaccaaaaagaggaaagcacagtttgagaacaagaaacaaggaggaaaaagatacgatgtggctagaggggtaggcaggggccaaataatccactaggagcttactgaccatattaaggattttgatcttttactctaaaggtagttaagcagcctaggaattttaggatgagtgttcgcatgtgtgtgtagcggggcgggggagagcggagagaaactaatcaaacctggattttgaaaagattatttcagaaaaacagattgtaaggggaagaggggggtatgatacttaggaggctattacaggaatccagagggaggattacttgggtgggggtgggggggtggtgggagggagaatgtaaatggttgaaagtacggataaaacaagtagaaagacctgaggtgctcagcaaatcaaagctgaatagaacttgctaatcaaccattcaccatactaggtagacatccaaattgagccaggtaccctggatttggaatagtctttcaactctattgcctaatccatcagactaaggactgtatctcttatctaatgccattgtaataattttttcaaaagtatctcaggaacccaaggaaccttcctctgaaaccataaaacatcttgctgggctgaaactactaacctacaggctgattgatctttgtccagaaataaataaatgaatcctccttctgaaaccacaaaacatcttgctgggctgaaaactactaacctacaggctgatctctgtccaaaatgaatgaatgaatgaatgaatgaatgaatgtcttaaataatctacaggccaacctttgtccataaataaacaagtaaataaataaaattcctatatgcctcctctctgatattaaaataggcttcacttaaaatgtttttagaagacacagctaacataatagcttagtatgtgctgagcccacaatcactctgagatgggtcttgtttgcatttttacatttgcattttgtgtacagatgagaaaacagccatttagtggcagactcaggattcagattccagaggctaaactcacatataagtaaaacttaagagttgctcggtgataatcttttcagtccttattttacttgacctctctgtgcaggatctggcctgctgacaggtgaatggtgtttacacgggtgttcactttataataatccattaatgtacatttgctttatgtacttttgtacacatggcaatatatttcacaataaaaagatataaaaaactaagtcaactagcaagacttaagtcagggtaacttacatgaaaatccggatttgcaacctcttgaaaaactgggagatctggcctgtcttcttccaagaaaacaatcagctggggctgagcaagagctgcttcctttagacaaactggcttgtgctctgatggagcagtgccctctcttctggctttcatgattcatgctgcttttctggtctaagacttacctaacaccatcccatactcttctccctggtgctctcttacaacacacgaacataaaaggatgtgaatgtatgacttatagaacatgtaagtagatgtatgattacctatggcaagtaaatttaacctcagatccttcacctgtaaaaacagagataatcgtagtatctaacagaattgtgaagattaaatgggataatgcacataaaacacttagctcagtatctgtcacagagtcagcatgcaatataaggggctactgtttgttttgacacatatttctcacacttataactaaaatgtaagcctacttgccatggctactgacttgatttttataggtgatacagcatcaaaatagtgtacttctgtattaacactccagtaagtattaatactccaataactgccactgttagaaaaaaaaaatcagtaaataaaccttccttagtacctttatatgacattaccaggaaaaacttccacaattatattttgaaaggcagactcatttttgccagattcatgtatttcccctgattgtggcttttggtggtctgatcagtcaggtaagtggatatcttactactaaaacatacttcaatacttactactaaaacatactttagtatgacaaacatcttagtcataaaatatcctccaaactaagaccaacttgatttttcaagataatcataggaacaccaaaagaagcttactaccttttgctcagctgttggtactccaatgactgcctcataatgcatatctaattcttgcccctcagacagacatatacaatatttttctccaaaaagccacagaagtctaactgaaactattttctcccgaaaccaataaagtcctcatacaatggaataccatgaagtacaagaactgaatgaaaactaatgagctacagttctccacaacataatcttacaaacataatgctgagcaaaagaagccatatacaacagaattcacactagaagattctgtatgcgcaaagttcagagagtcaaaactagtgctttcagaatgcataattaggtggtaactataaagaaaaactagaaaatgagaaacctagaagacaagatacatgcaatctttgaagaagggaggatatgacccagaaaaggcatgttagggattctagcacttatcattatggacagaattttatttgctgctctctacccgcaccattaaaatgccctatcagtacagagatgtgttcactgctgcatctccagcacctacaacagtgattggtacacacgaggtaaccaacaaatatctgctgaatgtaaaattccgctttaggaatccaaattgttacatatttcacagcttcttgaaccctaaatgtaacagtaacagctagtatagtgttcatttgccttgtcagtatattcaaggagctgttaagcatataagccaattactttataattcttaatgtctccctcctattgagatattgataccaaacatatgcagaaaacacttacatcaatgtatccagattcaattcaaacatttaaaaacattaacaaggaaaaatacagaaactctgctaaacagcaagcccaggtttagaaaatgactttgtcacctcctccaacgaagaaagcacacaagaatgctctgttattacaggatgaccataagtttgctcgtatttttaagagtaaacaatgcaaatcctttgtttcttcaacaatgagttacacaattcacaaagtgatcattacagcgtatagcagttgaaaactgtaaatttctaggatcgggatcccaaacaaaatgtactcatttaatatgtgttaagctaacaaaaagaattagtcattactggtatcctcctgaattttaaaattacatactaaattaagtgagctaatcttatattaagtttaactggtgatattcagttaccagaaactgttgtacaatctccaagataatgacaattccaaaagcgtgaaaattcctaagataaccaagaagaaaaatgaacttttcagtctttgggaatttacatttttttaaaaaggaaaaaatatttcggtaagtcaaaaaaaattaattaaaccaggtatacgctaatcttatgttcctaattagaatccacagaaagtaatatcagcttctgttttacctcctttccggacatgataaactagaattgagatcattcaccagttaactcacttcccagtattttcagtatatcaactgaaatatatccgcaacacaaactaataaaaccttatctcttgatctatcccaaagtgagggccacctgagattcagtattgagcactacatatatgacagggttttgttatcacatttcaaatggtgttttacagtacaaagtttggtaacattggtgttctcatgatctaaagctgtgttcttgtggtaaaggcaatcattcagagtccatttattttcatccatgcttaggatataagataaaactccctacccacgtattccccacatactgctcattattaagaatttatctgtttaagaggaatggaaataaagcacctggctagcccataaaggagcaacctgaagccactcttctctgcaataaataaataaagatgcactctaggtcagagagagcaaaagtcttatttttattgctggcttatgcaagaaatactgcaacacaccaattttataggattaactttaaaatctgtaaactatcctaatgtctatttctttctacaagactaaaagttgttaaagtaaaaaggtttttcaagatttgctttcaaaattcagaggtgcaaagcaagttccagtcaaatattccaggaggatcattctagacataaactatctttttatttaacatatcaaaactttgctaattagaaatgactggctcattccactagcttgtcttcagctactataatgctcagtcatacacaatgctgagcacgtgaatgctttcaggcaggcctgaaatgagcaatgactgagcagtcacagatgggtggcactacacatgaatttacagctggactcatggtctttcagtaaggtgaatttttatcatatcaggggtatgtcaagtaacaggattacgtcttcaaattttccaccaaaactattatttttaaagacattttccttagcagcatggtgatctatcatatttatacacagttttattcttagaactgtacagagtttacatttggtctctaaacagaaaagagattaaagagcaagtaaaagtcagagccagaccttgtttccaggattggaggggaaaaagggagtggaactactgtactttttttccttcaaatcaaacgggaagcagtactacatatactgcgttacagccctcgaagccacagattggtttccacctcattatttattggtgtctttccttttttttttttgagacagactctcactctgttgcccaggcaggagtgcagtggtgctatctcgactcactgcaaccttggctcaactgcaaactctgcttcctgggttcaaatgattctcctgcctcagcctcccaagtagctgggattttaggcatgtgctaccacacccggctaatttttgtatttttagtagagacggggtttcggccgtgttggttgtgctggtcttgaagtcccgccctcaggtgatatgcccgcctcagcctcccaaagtgcagggattacatgcttgagtctggcaaattggtgtctttcctaataatataatgtaatttgtgccaatatataacctgggggggaagaacaccacaatttgaaacataactatcttatgaagctgtcctgaaacaaatgtaagagttgtaaaatgtagttaggattatcagccaactatataaattaaagctttaaccatgatggtctaaaatgccaaacacacacaaaaattattgctacagtgaggatcattaaaagttggcagccaaacttcagtgacttctcacaaactacagtgagtttttcacttttaaaacagtatgaagcaagtatgcattgatcagtaactatcataattaaaacactgcatcactcactcaagaaacaatccctatatgtaatgactgactcttgtcattaatttttgttcattagcttggccattttctgcagctcttaaggtttcaaaaacgttaagatatcaagaaaagcccactgtatacacaaattaactcaagatggattaaagacttcaatgtaaaacccaaaaccataaaaaccctaaaagaaaacctaggcaataccattcaggacataggcatgggcaaagacttcatgatgaaaacaccaaaagcaattgcaacaaaagctaaaattgacaaatgggatctaattaaactaaagagcttctgcacagcaaaagaaactatcagagtgaacaggcaacctacagaatgggagaaaaacttttgccatctactgatctgacaaaggtctaatatccagaatccacatggaagtgaaactaatttacaagaaaacaaatatccgtatcaaaaactgggcaaagaatatgaacagacacttctcaaaagaagacatttatgctgccaaaaaaaaggaggtatttatgcggccaacaaacatatgaaaaaatgctcatcatcaccgatcattagagaaatgcaaatcaaaaccacaatgagataccatcttacacccgtcagaatggtgattattagaaagtcaggaaacaacagatgctgccgaggctgtggagaaataggaacgcttttacactgttggtgggaatgtaaattagttcaaccattgtggaagatagtatggcaattcctcaaggacctagaaccagaaataccatttgacccagtaatcccattactgggtatatactcaaaggaatataaatcattctcctataaagacacatgcacacatatgtttactgcagcactatttacaatagcaaagacatggaaccaacccaaatgcccaccaatgacagattggataaagaaaatgtggtacatatatacaccatggtatactatgcagccataaaaaagaatgagttcatgtcctttgcagggacacggacgaagctggaagctatcatcctcagcaaactaacaccagaacagaaaaccaaacaccacatgttctcactcataagtgggagttgaacaatgagaacacatggacacagggaggggaacatcacacaccaggacctggggcctgttacccgggttggtggtggggggaaagggagggaaagcatttaggaaaaatacctaatgcatgtggggcttaaaacttagatgatgggttcataggtgcagcaaaccaccatggcacacgtatacctatgtaacaaatgtgcacattctgcacatggatcccagaacttaattaaaaaaaaaaaagcccactgtgctccacttgatacaataaatcaattcctgggtatcatgtaaatcagtgtaacagtaaaaaatgacataaatcattttcatacttacattataatttcagatagccacagcgggcaatactactattcccgagacttaacaaaaacatttaagtattcagcaaaatctaataagcatatacaatagcacaatcttaaattaaattttattgcttcctccaaaggaaaacagcttgaaaacacagaagccactgaaacttccttcagccacttttctgtgattcaaccaatgaaatcgtttcttaacaatgattcataccactttcttacacatttaaacaattctttggtgacgcagagaaccaccctaattcttgtttttcaactttctaataatcttaaatcaaatacaccagtaaacaaaattctgactgcgaacgcagacgtttatcacacatataaaaaacgtttttttcctttatttatttatttgagacagcgtctcgctctgtcgcccaggatggagtgcagtggtgcgatcttggctcaatgcaacctctgactcccgggttcaagcgtttctcctgcctcagccttcccattaggggggattacaggtgctcgccaccaggcccggctatttttttttttttttttttgtatttttagtagagacggggtttcaccatgttggtcaggctggtcttgaactcctgacgtcgtgatccgcccctcctggcctcacaaagtgctgggattacaccgcgcccggccacgttttttccttcattactttttgtttttgagacggaagctcactttgtcgcccaggctgtagtgcagtggccccgatctcagctcaatgcaacctccgccttccaggttcaagcaattctccttccttagcttcccaagtagctgggattataggcacgcgccaccatgcccggctaatttttgtatttttagtagagacggggtttcaccatgttggccaggctggcctcgaactcctgacctcaagtgacccacccgcctttattacttctttagtatcatgcacggaggattcttttcaatctaggtacatacatatttttaagtagtattctacattttcttctattttagaatttttattgctctttgtcatttagatttcctttgattttttttagcctatgaggcagaaaacatttttaaaaaatggataaccaatagtcctagcaccatacattgaacaagccactttctccaatagtctacaatattattttttaccacatattcgtagttttccaccttgctggctaaatgaacttaaaagttatcgtatctctgtgtttcaatttcttcaccaaaaagtagagataatagttcacttcatagggttactgtgagaattaaataaattgagcacttagaacaatacctgacatgcaataatactgatgatcataattactaaaagcccataaatgcacagatgtttctggacctccctggttcctgaactgacgggctgctttaaatgactgtgaatttctaacaagtttcctgatacggccttctttttccaaaattttgtcgctatcattttatcatgtaggttttcttatcaatatgtcaagttttctacaatacaacactagaagacactgacttggggaaaattagtaaattctacaacagtgactgtctccatccagaaaatacattgtttcatctcgtttattcagatctcactttatgtccttcattaagattccagtagctcaccaatatttgttatatttatttctaggtagtctttttagagaaacatttagtagtatatatcagaatttaaactgcacatagcctttgcctcggtaattccatttttaagaatctgatatacagtaatatatgtgtacagatataaaaaggctactattccaagaacaaaatcctggaaacaaatgtctatcaagaaagcaaagataatctaaacagcagcatattcataggatgacaaactattcaaccattataaagaaaaccgaatcaaaagcactggcttattagacaagagtttcccaaactatcatgctaaaacagtaacagcgagcttccaaattaatgttgcctttttttttttttttttccaaactgaaaggagggtggggaaaacaaacgcatcatatgtaaagcactgagtccagcctggctcttagtaagcattttaatcaccttcaaaaattaaatgtgacttacggaaacaggtcactgaatattatttcatttcacttattcatttatggcctgttttgctctatataaaattctgaagtggctccataatacagcatcttaaaaaaaagctttcaacttgccctttactcgcaaatgtttacaatgcaaaaaagtccctacaacgtaatatttaacgagtgatgcttttcaatatgccatacaaatctcaatactataattcaggagaagtactcctcctaccttactgtggcaatccattgaaaacgtatttctctccatacttgaaataacctcttaaaaagtgtgttgtcttgcatattaagtaccagagatcacacttcaggaacaaagtgacattctgtgtaatacggaaacaaagcctttcctcctaggaaagaaagccccagaaaagacaaataatgggagcttattttaaaaccaaagcaaaatgttgccttttatcctaaatctctggatcaagttttacctttagattgttcttcctcaatgtaaggtcaaaaggtgcaagttaaatttttcttaaacgaagaatactatatcccttaaaacaatctattcattaataagtgtaaccgctagcttctcccagccagcaaacaagcttctgtgagagttcaaaagtttcagaggcatagtattcctgctcccagatgttacgggtaagcatttcaaacaaaaatacacacagaaaaccactacctgcccaagtatctcgatactatttgaagtaatgaattgatattctttaaaggggagattttttactcctcacatttctgtattcctttgtttgaaataacaagtactattttatgatgaaaaaattaatatacaaaatgggaggagcatcctagctgtttttcaggaactttggctttttaatgtaatacacaagttagtttcaaagcaatgggaaaatgcaataatatttcagagcacataggaaaagtaacaggaaaaacgttacttttttcggctgaactcaccggcctttactaatttttaagtgctcatcttattgtccattcgtaggaatactttgtattacttgtgaaagtttaattcaagttaaattattaaatgttaaagaggttattttcaaagttaccttaaataagtaatacagcatgaaagaaaacccgacctactacgcctcacaggctgagtggagtgttttgcagtctcaaagccttatcgctggcgtgcgcataccgcagggagtgacatcagatcgaaactacagggtttcgccggggaccaaccactcctccaaagacagcagctcccggccagcaggaggtggcaccccaagccccgacccgctgagagccggcttccagcccccgaaccctcactggagccgagtttctccgcgagggacctgttgcgtgtccccgccctcagcgagccgcagccaggcacaggcgccggcagctatgcacctgcccagtacggcggccgggcgcccgcagccccctccccggccgcccccagtgcggcccgcgccgcccccgcccgaggggctccccgcggcccgcggcccgcggcccgcggccccgcgccagccctgcccaccccgccgccccggggcccagacagccgccagcgagggagggcgggacgcgggccagatgccggtgggcgggcggcgacggtcggcccggtctggccctggcggccgcggaggcgctcaccttggcggccgcagctctggcggacatcttgtctctctccagcgccgcgcgaggctcctcggacccgaaactccgcggcgctggcccgcccgctcctcacgccacagcccaaataaacatctcccgagagcgagcggggcacgggcgggggcggccggaagggcccggcccagggggagggaattcaactcggacaaaagtccgggaagcgcccgccccgcccgggtcttctccacggggcgcgcccgaccggcacctccctccgagcgcggccacccactcggcctcccgcagctttcgcagcccggccacgtcggcctcgcccggtcgcccgcccgtcagcagcacccgtggcctcccggcgtctcctcggaagccggcttcgccacgtaacttcccgggaaccggcggccgccaaggaacgcggcgtccgctggctcagccggcgccggcaactcagcggccacgcaaacctgccggcccggcccactgagcatgcccggcccggcgggggcggggctggacgaggcgaggcgaggcgaggcggggagggggcggggccgcggcgggggagggggcgggacgagcggccggggtcccgaccccaagcgcggaaggaaaagccgggtaacccaagtaacttggaagacagtttccgctgccgtgcgagtcttcctgtttgtttttatccaaggtctggcagaattcgcccccaaggagaaagcgcctgtgcaccaaagctttccttaagagacttgtccacttgctcctcgacaagccacgcacatcatggggtgagccccatgcatgagtgcggctggaaaggccggcagagccgatacccgacagttgtttccttcactgggcaaacagcatggtcacggctgtcaccgcgtgcctcggcgttgttcccacggaaggcggaatgcattttctgcaaggcgcgtcatggctttcatctccgaggagctccggcagggtcagaagcgttgctctcgttcaccggcgccgactgccaaggctgaaactggtgatgaggtcatgggcacccggaggcagcagcctgagaaacaccctagagacctgtgacatctcggcccacaccccacattagacctcaagatatatccaaagtctctttcccgcccatctagacaggaatcttgaaaagtttatttttggccatcaagattgctgaaattcttgttgaccgaacgggtcaagctgccctgcattccaatgctgtccctccaactcaaagttgggcagaaaagggtgtaaacacgtgcagtccatggtccagtttaatcagccactacacaaacttcccacaatgttgacggctttgctaaacaccaaggaacatggtaagaaaccaatcctagactcactaatctacacttgtaaatgtaaaggtcttcaaaaaatgccagaaatccttagtaacatcaatgataacatctttaaagtatctggtatagtgccacaaccggcacagaagaaatggaagaaatcataaacatcaggctttagacaatggttttctctttagaattcaactgtatgaaaagaacaaatttaacaaagaagtatgtgtaggtgatacataagtatcaattaaggcttcgaagtgccacacatcttgcaacccaaagctgtctgaaccagaaaagagccttctgcaaaccaaacccttattcctttttgttcttcataaaaatggttgaagtcatttttgttttaaagtcatgttgtaattgttttgcttttggacaaagtattatttattcttttaagaattgtgggccaggcgtggtggctcacgcctgtaatcccagcactttgggaggccgaggcgagcggatcacgaggtcaggagtttgagaccagcctggccaatatggtgaaactccgtctttattaaaaatacaaaaattagcctggtgtggcgcgtgcctgtagtcccagctactcgggaggctgaggcagaagaatcacttgaacccaggaggcggaggttgcagtgagtccagatcgtgccactgtactccagcctgggcaaccagcaagactctgtctcaaaaaaaaaaaaaaaaaaaaaaaaaaaaaaaaaaaatggtggccaggcgtagttgctcacgtttataatcccagcacttggggccgtgcgcagtggctcaagcctgtaatcccagcacttgagaggccaaggcaggcagatcacttgaggtcaggagttcgaaaccagcctggccgacatggtgaaaccccatctctactaaaaataggaaagtagccgggcatggtgacagacgccagtaatgccagctattcaggaggctgaggcaggagaatcgcttgaacccgagaggcggaggttgcaatgagctgagatcatgccattgcactccagcctgggcaacaagagcgaaactccgtctcaaatcatcatcatcatcatcatcatcatcatcatcatcccagcactttgggaggccaagaccagaggattctttgaggccaggagtttgagaccagcctgggaaacagtgagaccccattaaaaaaaaaaaattgtgattaaatttcttcatatgcaaacaccatttaaaaaggtttgggaagtattttttaattttaaaaggtggtgatgaaagacctttcacattatctttaccatttaagaagatgtgcaattgcataagctgcctagaactaggtgtggtgtctttaatagcacctaaatctagagacactatctacaaatgcactgacatttttcacttttccttatttgtcacttttacaagttgcccaatgtgtaatttaaatgctagattgcaactatttgtcactaattaaaaatagttatatatttaacagttttatctttgccatggtttaaaaaatgaaatcaaacaaaaatatttcatcttgaaaatattattctttaaaaattatatttagtatttcagtgactaatagtatcactttaaaatttttcagtggtatttttaatatctaaattaaacttcataaagtctgttctttaaataaacaagagaaggcttttatcatctgtaaaataaaggtaaaactgttgccaacaattaaaaacaaagctttattcctgcagtttattttttaggtaggtgctttgacaacaagtggaaagtataaagaataatctgaaagaatcacccatttaacaattaaagagtttatccatggaacaccaaaaaagtattttctgacttttatgcttacacacgcatgtcatcatagctcctctagatcaatatgggaagaaatacaagttaattaaggattctcatttagagttactataatgtttaaccacaaatctctttcgattgtacagatttatcttatttctgatcatctctgcaactgaacaggaaactaaaaaaccacaacacttaaaagacaacttcctgtgggatttttggtgtctgcggctcagaatgaaaaaagcattatgtgtgcaaaatctttacacattttagatagaactacttaataaaacagccttgaccaaatgaacaactatatccacacctaatttgtatatatgtatatgtatggttttaattgcaaaaaagatccttaggaaagcatatttatgttatttttatatgaactgtgagtttacgcttgacaaagaggaagtatttatttacggtagtgaagcattagacaatctcgataatgtcagagaagagaatatatacaaaatattagaaggagaagcactttatcaagatgttataacaaccaaaagtaatcctgattccactcctatgccataccattaaagattctacaaattgttacagaattttcctctgccaataaagtcatgtaacaatgttaaatgggggaaagattcttttaaggctcataatgtttctaaatttcatagaccagtaaaaattttaaaacgatcttagaggtgcaatataggagtaccaactttttaatcttataaagtaaaaacattttaaaacaaacattataaactgtatatgtaaagataattaaaatggcaaattttatattatgtacatattaccacagtttagaaatacaaaaagaaagctattaccaacaccatttcatttttttttttttaaaaagaagacataaacactaaaaaacaagtctttttaaattcaattcagtatacagaaagttattcctcgaaagaattcctcctatggggctacccttacctctgactggggctaaggtggagttttcttttttcagggtcccaaatattgcacaaccaggcaggtcggaagctccataaatccatgactggaatccaggcaggctggcatacaggcctctggctcatcccttagcggtttgtcctccattcttcacagcttctccactctgatctacactttcctatgattcctttaagactccctccccagcccaggcaaaacatctcatctcataatccatagagaaaacagacattaaggaatagaaactcccttcccttcctgccaaaacactgacaagtctaccctgggcatccgcttttcctctccatcttccccccaagggttatgaattccatcttggggggctgaccctctcagctgtgtcctctttctgtatcatcttcatcctgtccttagctaatgaattctacctctgagaattcaagcgtcttctagtgtttcccatcttaaacacagtcagggctccccaggctacctaccaaggtgtgcactactgcaggtatacaagaccctagggcagaagggcttgcagttggggtttaatgtggttgctgtcttgaattgtaaggactttcgttttggatgtgtgttttgtaagtgaaggtcaatgggaaaatgaggcacacactggggactggggcctctgctctcacagggtcctgtcgcctcctaggagggtatctgggctgcccgctcccacagctcttgatacccctgctggtcctctcccactctgctccactgccactgctgaaagggatccaagcaaggtgtggggtttaagtatgcatacccacagcatcttgagtgcacaaaagccccaaacgggcagtgtcactttctgtctggtggctgcctggctggaggcaatctcttggtgagggtgagcctttggcccagcccggattccagatccagtcatggaggtttaaggatccttggtggttaccatctgctgtgggttggagcaataggcccgtggctcaaagtccccaaaccctgtccccagcagggcattcaggtcaggaggtttgcatgaatgtcatcacagcaagctatcaggcccagcacacattagtgggaccccagggccctctgaccgtctgtacttgctctgattacccacccctaatcctctagggccccagggccagagtgttctctgggctgtttccctgcctggggatgggatcctctccctccttccagccttcccgagtctggctgtgttcagtctcttctagccggcttgaggcatcctccagggacaagccacagaatataaactgtgtaatttcagtgactccacatgagttaaatattctgaaatttgcatttaaaactggtgttgcacaatataaacagtaaaattcatgctgataattcacatttttaattgttctttactctgaacatgaaatagtgcataaaaaacatgacaagtcaggatggaaaccctggaagaaaagaaaaagctttaggtgtacctttaatgacacttttttcctccctttgaaacaaagggcccctagattatagaggcagctctgagtccacctcttcctgcagatactgttctgtcagtttgtgacaagcttctcaagagtcgtctgccacaactaggtctttctgttgtgaatgcatgcccaggtcttttggcattcttccccctccccactttaatttcacaagtaatactggcatacagtccttctgtaaaagattcatgcaattgatatattttttaaagtccaacagaacaacatccactgcattcccattcctataattacccaggaataccatgatctaagcctaactagagagtgtatttctagatcactttctgtatatttatttacgtgatatgtatgtgtggagacagaggagagagagaatatatgaatataagaatgtatggttttgtgtgttttaaactaatgatagataatatttatattccataactttttaatgtaatatttcaccttggagattatatcaaataatgaaaatctgcttcatcattttaaaatggctgtttagtattccataatatgggtgcattatagtttatcaaactaagattatttctattataatgtcacaacaacaacaaaaaaatatatatatatctttttgtatacatgtataagtatttctctaggagagacatccaaaaaggaattattttctggattaaagaatatgcttacttaaaaaaaaatttcactgatactgccaaattgccgtctaagaaaaccagatcagcttattttgtttcctcctctccccccatatgaacacttgataatattaatcttttatagtttcacctatctggtagacaacaatggtatatcatttgcctattacatcacttacccattttgctctctcaggttatttcttttaatttgttaatgtgttctttggaactgaatgaattgagtcttttttttttttttttgaggtggagtcttgctctgttgcccaggctggagtccagtggcttgatctctgctcactgcaacctccacttcacgggttcaagagattctcctgcctcagcctcctcagtagctgggattacagaagcctaccacaatgcctggctaggttttttgtttgtttgtttgtttggtatttttagtagagacggggtttcaccatgttggccaggctggtctcgaactcctgaccttaagtgatccaccgccttggcctccctaagtgctgagattacaggcatgagccaccatgccgggccccaattctaagtcttggctcttggccggctctatgtgtgtgtgttaagtacaatttgtttcagaataagtttagctttacagaaaagttgcaaagatagtacagagagttcctgctgacttcccctaatattaatatcttgcataactatgggacatttgttgaaaactaaacgattaacgtgggtacagtataattaaattgcatcaagttctgcctgttttaactctttaatttctcttatatgcttccaattttgccaattcctcctactttccaaatgtgaaaactattttggacatgttactttcgagcctctggactttcataagcttaggtgtgcgagggtgcctggaggaggcagagagcataaatacaaagtcacatagagggtccacgtggagtttcacatttctgattcagttcaggaaacttttttcctcatgctcacctttatgaaagaactgctgtgagacatttctgagcctcaaacactaaggggagagtagaagaaatttacagctctttagattagtctgtcctcccaagatggcagggagtgccaaattcattgccttaaaaaaaagaaaaaaaaaaaaaaagatttcttaaaagcagcagaagactcccccagagtataatgtttgcatttttttacaatgtgtgtgttataaaacctttataataagtctttcaaaacaaataaatgtaaaatacagaaaaattagtagaacttgctaaaacactgcattttaaaaagaggtaagcatactttttattttaaaaatgttttaaaggacgataaatacacatctgtaaaaagaaacactggaaggaaaactaagaacaagtaataatggttacttttagaggagacagagggcagcaatgatatgagacttttctagatatgccctataaaccactttggctctggaaacaaaaattcttacattaaaaaaaaaatacaatgaaatttaaaaaaaaagccatctctaaaagctgaaaacaaattgaagaaagaaaattaatttacattaaatcagtgacctaactaaatagataaaagaattatttccaatgacactagcatattctaatgaaagtggcactgtaaaaaaatcttaaatttaattcagtagtcttttagtaataacactattactctgaaactgctctatatgtgtgtatgtgtacatcaactaaaactgttacatattcattagcatgtcatctaatatgtaattacacatgtcagaataatattatttatatgataaatgtataataattatatataatgtattgtctaatatatgatgtaatatatattagtacattttacgtctattagcaattaacacacatcaatttatatgaacattaccatactatgtatataatagttttgaagctacatataaatatataagaatttcaaagtaatattaacattattatatattagtgtataataatgctaatattacatattattacactaatatatattaatgtgtgttaatgttgttagaaaccaagattttctgtttaagagaaaagagaaacaagtataaaataaaaaaagttaagattttgcaattctagtttaagttgaaaaactcagcattaatttttttttaatataatgcctagctctggccattgaaaaggactgggagtaatggaaattcaatagcaaggagtactcctaatgtccgtattgtaatctccaactaggaacagctgattacaggtctggagcaagaaatatacaagataatattgggacattttgggccagaaagcaaggaagttctcaaagaataatgagtcaaaaggatacagaagccaacaacaagtagctcttattggccaaagatgatacaatttgatcctcaaaagaaaagaaacaaacaaaggaagaaaagaaaaagaatgcacctgactgaaaaaccctgaatatctaaaacccattaattcacaataacaaaaaagagcaggaaagcaagagagcccccaaaacaaacaataacctattgaacacccctggataaaacttgggaaccaagtccgtactctgtaagctgtcaattaaaagaggagaaagaggagaatatattttgtatgaactttatttcagatagccaaataactctaattgctgagggaaagtttttcttaataaatctggaaggaattatagaaaatcatcatcctgtactacttaatgaaataatagattcaggcagtgatcatcaaaggatcaaatgatcaatcttagcatcactgaaggcaagacaagcaaacatttatgcctcccatgtgaggcaattggaagcacacagtagtatctatgaaggattcctgccaaaaagtgaaacctgaatgaaatccagtctacagggctaatgtgcataaacagaaatacaagggaaggaggtacaagttaaatgactccaaaggcaagctttacagacggatgtgggagggcctatataggaaaagagaccccattttaaaaacaagttaataaaaaagaaaaggaaaatgggactgctgtggattttatgtggatttcttttcaaatctactcactgtaaaacgacattttaaagacaactagagaaatttgattatggactgagtgttagatgggacctagatgtgacaatggcatcatgactacataaggaagggacccctttttaggagatacatgttgaaatatttacagttgaaatgacatgtttgggatttgcttttaaatacttcagcaaagagaaaaataaaaaatagaggcagcaaatgcggcaaaatattcaaaattggtgaatcaggcgatgagcacatggagggtttattgtattattcatctttctttggagtatgtttaaatgttggtgtacatttgacagttctttatcacgcaaatcaacaataacataaaaactgaaatatttctgtcagctaaaataggtagactgtaaataattgccatacattattcctgtccctgtttggatgtgccactgtggctcttctcatcaacagatggagtcttttcttccatcccttgaatctggtcagcagtgagaactgctttagttaaagggtaaacatgacacaagcagaggcttgaaaagcactagggcattggggcggctgagagccctgggcctaccacaggagaagttcagactagcttgctggagaggtcatgtggaaaagaaatgagaccctggctgagggtctgccaacctgtagacatatgagtgagggaattgtagaccacacagccccagccaagccacaaactgactgcatctgcagagtcagcccaggcaagtctagctgtctgagccagatttgccgacgcacagaatcatgattgttttttaatatgctaaatactgaggtggtttgttacatggcaatgactgactgatacataaggataaacctatagaagtactatacacatatgcagaaaactgtcttagcttcttagcactgtgagggacatgccatgtactcaataaggatgtctgaatgggaattccatgtcactagaaaatggtatatatggaaactgtctaaaggcaatggaaggcttaggtagactacttccttttgtgtatatgaagtactatcaaaccaagtagttactccactgatagaggcagatgtgggaagataaactatgtagaactttttttccttggaagactaaaaaggtctggctttgccgctggtcaactatgaccagacactacggaaacagtcattgagattgctggcagatggcctggcctttctcccctgacacaattctgcaacccaagtggccagtgtgtggagagaacacacatccctgtgagaggccgcctagcttttcctcccctaagggccacactgggccaccccagcacacatcaacttggctggcacactttcctgcaaagcagattccactctgtgtactctgagaacaaatcatgtttcctccttgccaaaggtttttgcttgcaaatgttggatccaggtataaggattaatgagggaatatttagagtgccacaaaaaaaaagttctatatagaagccacagaagtacatgtggatcttctagtagaggtattttttactaaaagaaaataccaaaacattttcatcttaaaaagctcaagtaaatctgatcaatttagcagaatcacataatttgtaataatatacgtataaggattgtgtagttaatcttagtatcattagcaaaatactatacttgtaaaagaaaaattcaagatagttaaatatttctccataatagtagctatttaattggaaaattttttgttttctttgagacagtctcgctctgtcacccaggctggagtgcagtggcatagtctcagctcactgcaacctctgcctcccgggttcaagcaattctcatgtctcagcctcccgagtagctgaaattacaggtgcacaccaccacatcctgctaatgtttgtatttttagtagagatgggatttggccatgttgggaggctaatcttgaactcctgacctcaagtgacctgcctgctctaacctcccaaaattgctaggattacaggtgtgaaccaccacacccggcctacttggaaagtatttttaaattaattgatactttaatctttgatgaatatagctattctcagtatattaaaatgactactcacacaacgccacccacatttacatgctaatttatccaacctcctcatttatatttttaaagatgcaatataatttttgtaagtatatatatatatatatatatatattttttttttttttttttttgagacggagtcttgctctgtccccaggctggagtgcagtggcgcaatctcggctcactgcaagctccacctcccgggttcacgccattctcctgcctcagcctcctgagtagctgggatacaggcgcccgccaccacgcccggctaattttttgtatttttagtagagacagggtttcaccatgttagccacgatggtctcaatctcctgacctcgtgatcggcccacctcggcttcccaatgtgctgggattacaggcatgagccactgggcccggccgtaagtatattttttaaagcttaagaatcttgtgagtaaatagggattttttttttttttgagacaaagtctcactcttttgccaggctggagtgcagtggcgagatctcggctcactgcatcctccacctcccaggttcaagcaattctctgcctcagcctccagagtagctgggattacaggcgggcaccacccgcccagctaatttttgtgtttttggtagagacagagtttcaccatcgtggccaggctgttcttgaactcctgacctcacaatccacctgccttggcctcccagagtgctgggattacaggcatgagccaccgcacagccggcctgagatgttttatactattttgcagtagcaaacttctatccagtaaatgtttcaagtatctttttgaaccatgactttggagttaacattattcaatgaggttaatgacacaaaaagataattaaatatggtgaacggaaagaatggacagtaaaagctaagaaaaattggtggcagcttcattatttgtgaaactaaacttgaaggggacaaattaaaacttgcagctgagcttcaagtgcagcaaaaaccggcagaaaccagggtccccacagggattctgcgctttggggagaacttctgttcttctgctcctgttttgtcctgttttgtctttctgaaaaggcaacacaaagagctgaggaaaagccaatagattcattatcattctacctaataataaaataatgttctcttaacaaagtgtggacacacatggcgaaggcatcagaaagaacctgatggaaataatctggaaaaggtcttttgggaatgaagtttcctcatctgcagaatggaggaggggtaatgagaggggcttgttgggggccaggagaagtgggctggatgaattccaagatcctttatagctataactttcagtgatctaggttaaaagctgaagatctttttcatccctgactatgaggccaatgtgagatgtggttatctgtaggtcttacagtgcttattataaaactatatattaatactttgtttccatgaaaagctctaattttaaatgtgggtaattttaaatgtgattaatatttccataacggagtgcatattatatgaaaatcaaaagttttataaaagctgggcacatttaaaaacatacaaaatcccagctcagcttaagtatatggttgcaagagtgtgtgttttcaaagggtggggcttcctgtctctggattgtttggaaacattctgacaaagccaaattcatttcactgatatcctgaatgcagcaaggaactggtgcctaaaatagcacaaaattgcctgtagtcccagctactggcgaggctgaggtgggaggatcacctgaccccaggaggttgaggctgcagtgagctatgatcgcgccactgcactccagcctaggccacagggcgagaccctagctgcaaaaaaaaaacaaaaagcacaaaacatgatactctaacatgtagaatcagtttaagtcaactaagaaatgtgataaacacccaaaagatttcaaatctgtattctctaaatccttttgagagagtctccacaattagctggactggaaaacttagcaacatttagcatacttttcggtcacatattcattcattctttttttaactattcaacaaataggtaaatagatggacggggaaagagagagagagagagacagagagagacagagagagagagaggagatagatacctcttactacatgccagaaacaatttcttttaaaatttttccagtttttttcttctttaacttcatactccctttgtctcctgtctttgttgggtatgattattcaagaatacatttaacttgtggcactaaatccagagcactctctaatagggagaaaacacaaccactgtggtgtcaggaggaggaagtaaatgtgtgagcagcttggtacactcttcactatcctcacctcaaaggaaatacagaggtggatcaggaagccagtttcaactggacttactgctgcttcttgctgacactattgttacgttatctgtgggatgatcaactttttttttttttttgagagacagagtcttgctctgtcgccaggctggagtgcagttgcacaatctcagctcactgcaagctccgcctcccgggttcacgccattcacctgcctcagcctcccgagtagctgggactacaggcacccgccaccacgcctggctaattttttgtattttagtagagacggggtttcaccgtgttggccaggatggtctccatctcctgacctcgtgaaccacctgcctcagcctcccaagtactgagattacaggcctgagccactgcgcccagccgggatgatcaacttttaaagagtcaacctgggacacagtgataatgacaaaaaccataacaacataacattgctatggtctgaatatccccccaaattcatgagttgaaacttaatcaccaatgtcatagtattatgaagtggggccttcagaggcaactaagtcatggagacagagccctcatgaatgagattactgacctgataaaagggctggagggagagagatcacccctttttacccatccatcatttttctgcctctgtcatgtaagaaaacagtcttcctcccctctagaggatacagccacaaagtgccaacttggaagcagagagcagccctcaaagacaccaaacccactggcgcagcccccttggaccttgcagcttccaaaacagtgagaaataaatttatactgtccataaattacccaatctatgatattttgctatagcaacacaaatggactaagacaaacataaaagaagtaattacacatgtgttactgctttaacacagaaaagatgtggaggtgaaatatattattctgtattatttacttttctgtaacataaatgttattatttaaacagaacaacaatagaactagttaatgatagtaattaatagtagaacaaattaagcaatgtgtgagaaaaatataacaatacttttaaatgtttctttctgttctctgatacaggagtttattttaactatttttttaaaaagtcttcctagcactttggtaggctgatgcgggtggatcacctgaggtcgggacttcaagaccagcctgaccaacatggagaaaccccatctctactaaaaatacaaaattagctgggagtggcagtgggtgcctgtaatcctagctactcaggaggctgaggcaggagaatcacttgaacccgggaggcggaggttgtggtgagccaagatggcgcccttgcactccagcctaggcaacaaaagagaaactccgtctcaaaaaaaattaaaaacaaaaagtctctatttgttatttaaattttgtaggctttatatgttgtgtattcttaacacatataaatgtacgacttttacaaagaaaacataaatacaacatggctaatttaaaagatagtacctatatttagtaacaacagcaaaagatcatgtcctgtttctttctgccccatgacacagtgggatatctttactctttctgtttccttttccaataacacttctttgaactgcctgcagtggtaagacatatctcttttgacttgcacctctgctcttctcaagcgcacaatacactgattcctggtatcaatccaatgtgatgacatcaagctaaatatcctctcaaaagcatctgagtgtggaatacctataattttatttcctagcaagaataggattttagacttaggaggattcatttccagctctccaaaaatgtccatccctttgttaattaggttgttagcatctataaattcatcacataggctacacatatataaaatatccactgttctataaaaccttttattttgaaacaatcgtagattaacaagaagttggccaggcatggtagctcacgcctgtaatcccagcattttgggaggctgaggcaggtggatcactggaggccatgagttcaagactagtctggccaatatggcaaaaccctgtctctactaaaaatacaaaaattagccaggtgtggtggtgcacatctataattccagctacttgggaggctgaggcataagaattgcttgaacccaggaggcagaggttgcagtgagctgagattgcaccaccgcactccagcctgggtgatggagtaagactgtgtctcaaaaaagaaaataaaacaagaagttgcaaagaaatgtacagggtagtacaagctacccacacccagcccctccaatgtgaagaataccttacataactctagaacaatattcaaaccaagaaattgacattggtacattccaaacatgttattcagatttcacctgttatacatgtactctgtgtgtctgtgtgtgtgtgtgtgtgtgtgtagtgtgcacagctctctgcaactttatcacaatgtagtctttcttgtataaccataaccaccaccaccactgagggatttaactatgccttcaccacaagactctctcatgttactccttacagcctacacccatcctctctccccagtccctaacccctggcaactactaacctgttctccctctctataattatgttacttcatgaacattacataaatggaaccatacagtacgtaacctgctggaattatgtttgttcatcaccgtaacttccttgaggtttatacaagttgttgcatgtatcaatggttccttcctttttatcagaatagtaatccacagtaaaaattcaccttttttttttttttttttttttttgagacggagtctggctctgtcacccaggctggagtgcagtggtgccatctcggctcactgcaagctccgcctcccgggttcacgccattctcctgcctcagcctcccgagtagctgggactacaggagcccaccaccatgcccggctaatcttttgtatttttactagagacgaggtttccctgtgttagccaggatggtcttgatttcctgacctcgtgatctgcccgcctcagccttccaaagtgctgggattacaggtgtgagccaccgcacccggcctaaattcacctattgaaggacatttgagtggtttccaaatttcttgctattataaaaatagtggctgggtacagtagctcatgcctgtaatcccaacactttaagatgccaaggtaagaggatcacttgagcccaggaattcaagactagcctgggcaacatagtgagacctcatctctacatttaacagtttaaaaattagcagggtgtggtggtgtgcacctgtagtcccagctactcaggaggctgaggtgggaggattgagcctaggaggtagaggctacagtgagctatgactgtgacactttactccatctttggtgacagagagagaacttgtctctaaaaatataaataataaaataacaagaaaaatattatacgaaaaccgtgaaactgttatgaacattcctgtacaaatccccatgtgaaaataactcttcatttctctggaataaatgcctaagaattgaaatgataagttgtatggtaaattcatttttagttttgaaaggaactaccaaattgttttccagtgtggctgtctcattttatattcctaccaccaatgtaggagtgatccagtttctttgcatccttgccaacatatgatgttttcactattttttcactctagccattctgatttgtgtgtaatgataccttgtggttttattaagaatttgcatttcttcaaaagctaatgacattgaacagcttttcatgggcttacttgccacctgcatgtccccttgatgaggtgtgtgtgtcttttgtccagtttctaatcagatttttttaaactattgagttttgagaggtctttatatatttatgtgcaaggactttgttgaatatgcgatttgcgaatgcagtattttctctcatctagtttgttttttcatcctttcagcagactctttcccagagcaaaggttgattctgatgtgttctaattgatcagtttttcctcttatggattgtttttggcatcaagtctaacaggtcttcacccagtcctaagtcctctctcttatgaattttctagaagttttatagtttcacatgtaagtttgtccatcatttttaaacactctgaagagatgttattaagttaaacgtctctttctcaggttgggcaagagggaagaaatgtaggtgaggatagacgaaggggcgataagaaagggtgacggaagacaggctcggcagactttcccgtgagagaaatgctccagacagcaccctgttcctccaggagctgaatcttgggcatggattctccctaccccatccccgcccatcctgcccacaacactgccccaggacacgcctcctgaggccaggcagcctccatctttatgtggccaaagggggtctaggtagttgtcagcttcagcttctggaaagagaccagctgctgtatccagtgggtcccagtggtttgcttagataggatgccactcactatgccaggtgtttgggatagaagaaagaataactggaaggtctcagtattcaaagaacctacagtccagagaaggacacaaaataagaaagaagagagcaagggctaagggtacaggtaggagagagaagcagaaaaggggagcataactgagacttcgggaaggctttcctaggagatagcactgtagatgtgtggctatctgaaattgcaaactgtgaaccagagaataagagttcctgcatttcaaagtccttgaagtagatttcaaagggtaccagtttgagggctgctcttctaaaaataggacactggcatttcccatgagcaacaagaactcacaagaaggtggaatgtgactggataaggctgacaacaaggggaagcaagcctgacattctccccaccagcctggaagtctgggccttagcaaatgtgaaaggctagggttcaagctgaaaccccgtgtccttatgtaacctagacgaggctgcagtttagttgggctaggctacggccaaaagcttaccaagcagaaattcagggggaaaatatttcagcaaaaatatttaacccactgaaaataatttatacttgttcatatgtttacaaacaacctgctgattaaaatggctcttaactactcattaaaaggaggcccacccttcaggacctatactttgcaacacttagttactatttaattggagatacagtataagcaaaaatatgaaaaggctgcatttctttatatgctataattttactttgtgatgattctaactttctctgccctcaattagtctgatttagtgatgtcttgtcatgtataggctataaaatcctgatgctgtttctcaacttgccagtcagaatagcaggattaataaattctcaagatttttaaaagatcaaaattggagcccctgtttttttccttccttcctcctcctccctccctcccctcctttttccttcctttcttccctgatttttagtaacatttatcataaaaaatacaacctatatatttcttgaccataacttacatgtgattgagaagcatcgaattagagtttgtggtctctgtcttccaatatcttgtatgtactatacataataaagttggttcatcatcataactggggctttttaaagccagaaccccatcaagaattcccataagtaggaacatttccagaagtggtagggtacagtaagattttttgatctgctggtaaacgctgacggggatacccacttaggctattttattttgaaagagcgatgaaaatttgagcaaatgatagcttccagatacagtaagtcctcacttaacatcattgatagagtcttagaaactgccactttaagtgaaacgacgtataacaaaagcagttgtatcataggttcattgatataaacaagagttaagttcctggagcgtatttctggccatgaaaacatcaccaaacttctaaataaaagccccaaacgcttctaactattaagcattgaaataaatgtgagctatacatacatttaagaaagattaataagaacaagtaagatagctatttactcaattcttccattatcaggaataattaattgagtctgccagatcgtgtcccaacagctcagggtgcaaggagggaaccaaccctggacagtatgccatcccccaccgcaggtgcacccacacacacccacactcacactgggaccaagcagacaccatggttcacctcacatgcacggctttgcaatgtgggaggaaaccagagtacctgcagaaacctacagagacatggggagaccatgcaaactccacacagacagtggccccgcgccaggaattgctttctagtcaatgttgtaagaaaatgacattgaatgaaatgatgttattcaagaacctgctgtaaaggaaggccaatatatgatcagaagtgcacatctctaatgaagaaatcaggaagagccattttgctttcccttaaccctgctgcccccaggtaacaatagtaagtttccttcagttacccctttcttttccacatagaagaaggaaatttcacttttgaaatgttgaattatcctgttttcacgcaagcaaagttgcataatggtcttggctttgccagctacatggtgtctacaggtggacaaaatgcctatttctgtgtccttaccaataaaaatgggataatcactgatttttttaaaaagtcattgctataaagattaaaacgaactcctgtatgagaaagtaaataaaaccactaaaaaatatgagtaaaaatgctcattttgtaaccaaatgattctttatgtcccttttattttgtcctgctatttgctattgattgctgttcctatctttgacttttctttctgttttttttcttttttcttttctttttttttttctttttttgagacggagtttcgctcttgttgcccaggctggagtgcaatggcgcaatctcggctcactgcaacatccgcctcccgggttcaagcgattttcctgactcagcctcctgagttagctgggattacaggtgcccaccaccacacctggctaattttgtatttgtagtagagacggggtttctctatgttggtcaggctggtctcgaactcccaacctcaggtgatccgccagcctcagcctcccaaaatgctgggattacaggcgtgagccaccgtgcccagcctacctttgatttttctatcaatgcaaagttggaggagttaagcaaccattcctaagatgaagaaagttatcttctagaccaaattcaattttcagcagtaaggaacagacaaaaaatcctcttcccctgccccacagcttccattgtactagaaaaacacagacaacaaataaaacaaataagaaaaatatgtgaaatgttcaatggtagtaagtgctagagaggaaaaactaagtgaagaaagtgaaggaggaggatagggcatctgtggggaaggcaggggacggctcaatctatggattcaggaagggtgtggtctgcgtgctcccagtgtgagtgtgggtgtgtgggctggaagaggccagggagtgagtcacatgtacatccaggaaaatgcttccaggcagaagggacagtaaccacaaggtgggagaggccttgatgtatctgaggacagctggagatcagtgggctgaagcagagtgagaattgaaggggaggagagcaaagaagcagcagagctgggctagggtgggcagagcaccagagtgactgtttttttgtgtgttgttttgaaacagagtcttgctctgtcgcccaggctggagccttgagacggagtctccctctgtctcccaggctgcagtgcgcggctcactgcaacctcctcatctcgggttgaagcgcttctcctgcctcagcctcccgagtagctgggactacaggcatgcatcaccacgccggcggatttttgtattttagtagagacagggtttcatcatgttggccaggctgatctcgaacacctgacctcaagtgatctaccctcctcagcctcccaaagttctgggattacaggcatgagccactgcacccggcccacagtggctgttctaacagaaacgctgctgctgtgcagagaaggaaggcaagagcaagggtggacacaggccagtgaggtggcaccagcagtgacccagggatgaggtcatagcagcctggaccagacagcatcagtggatgtgctgctggactccagacacatggtgaaggcagagctgacaagatgcgagggtagactggatgcatggtatggagaaagcggggagtcaagattttttatctgagcaactagaaggacagcacagccatctagtaagatggtaaagacttctggaaaagcaggttttggaggctgatgtcaggagcaagtttggggcacgttatatgtgagtcatgtattacatatccacctagaaatgttgagtaggcaattggtgagatcaatctggacttaaggagaaatattcaggttggaggtacaaataatcatcaatttaagatgctatttgaagccatgaggaggggctagctcacaaagcagggtgcagataccaagaagagatccaagaccaggctttgggcatgccaatggtaagaggtttgggagaagtggcaatggtgactaagtttgagtggacagtaagacagagtatggcatcttggaagccaactgcagaacatgtttgaaaaaggaactgattgaccgtgacctgtgtcaaatgctattgttaggctaagaagatgataacagaaaaatgaccaaaatggatactcccaagccctcaaacaaagtatgctaaagcagtttttaatgttttaataaggtcttaagtttaagatgagaatttgcacaaatatttatatcctctcctaaatctcactaaaatgaccctaaaaataagaaaggataaagacaatattggtcaggctatgtctcttcctctctcttccctaaactctaaacagatgctgggattaattcaaagatggattttccagcttaaactgactattcatcccaggaaatccagaggaatggaagccccagagatacaaaaggaaatacgaaacctcccaggactccagcaggtttgtgaggagataacaatataggtggagtgacaagaagacacacataaaaagtcaagcaaaataaagaagacaaatgtcaatttacaaaataaattgtactggctgggcgcagaggatcacacctgtaatcccagcactttgggaggcagaggcgggcagatcacgagggcaagagatcgagaccatctggccaacatggtgaaaccccatctctactgaaaaaaaacaaaaattagccgggcgtggtggcaggcgcctgtagccccagctgtcgggaggctgaggcaggagaatggcgtgaaaccgggaggcggagcttatagtgagctgatatagcgccactgcactccagcctggtgacagggcgagactccatctcaataaataaataaaattaaattaaaaagttgtactaataatctaacatagttttcactattctattacaaggcagcagagagtgctggctcaccagtggccagggggaggtcaacattcacatggattaccatgagcttctcaattcccagtcttatctccattccctctcagctacacatatgcatgggcacacaagggacttctccatcatcccaaactgcctcctcccccaactcactgcactcacacctcctaaccacacacacttaactcctatctttgcgtctttcttctcttgcctcctgacccctccaatgcattctctacactgcactcaactgatctttaagagacccatcaccataacctctcctgcttataatcctgcaaaactgaagcccacatccttaatatggcctacagctcctgcagatcagaccttcctcccaggcttgtccaatgtctttccattcactgcgatagccccagtgagggtccccccagttctaggatggcaccatgctccttcccagctcaggccctgcacctatgctgcgcctttcattgccttctccaccagtgcctgacatggcacattagaaagctttcggttaataactacttctctattcacttgctgatttgatatcagggagttacacacaagagaagggagacctggataaaagggggaaatgacaagcagagagagcaaaatgatcagtttattcactcattctagacatattgaagaggttagggaggtccaggtaaattggagcagtggaaatcttaaagagccaggggtcaacatatcagccctacaaaagaaaacaaggggcctgatgcggtggctcacgtctgtaatcccagcactttgggaggccgaggcgggcggatcacgaggtcaggagatcgagaccatcctggctgacatggtgcaaccccatctctactaaaaatacaaaaaagttagccgggcctggtggcgggtgcctgtagtcccagctactcaggaggctgcggcaggagaatggtgtgaacctgggaggtggagcttgcagtgagccgagatggtgccactgcactccagcctgggcaacaaagcgggactccgtctcaaagaaaaaaaagaaagaaagaaagaaaacaagggctgagatcaaggaaaatggtctgaatacatatcaatgcctgattcaagtaatgtttggaagaaatcagtaaatatttattgaacacttactatatgcaaagcaacatagtacaaaacgatacatagtttacttttgtttacttgtttatttaatttttttgagacggggtcttgctctgtcacccaggctggagtacagtggcatgatcacggctcactgcagcctcaaactcctgggctcaagcaatcttttcctctcagcttccagagtagctgggaccacaggtgcgcaccaccacacccagctaatttttgtatttttttgtagagacgagttttgcatgatgcccagccaagaaccagccttttgattttttgcttttttcttttgttttcctatttttaattctattaatttctgctctttattattcccttcttttgcttgctttggctgattttgctctcctttttctaggttcttgaggtagtaaattaggttactgatttgatgccactctacacttttaaagtaagcacttgggctgggcccagtggctcacgcctgtaatcccagcactttgcgaggctgaggtgggcggatcacgaggtcaggagattgaaaccatcctagctaacaaggtgaaatctcatctctactaaaaatacaaaaaattagccgggcgaggtggtgcgtgcctgtagtcccagctgctcgggaggctgaggtaggagaatggtgtgaacccgggaggcggaggttgcagtgagcagagatcgcgctactgcactccagcctgggtgacagagctagactctgtctcaaaaaaataaaaataaaaataacataaataaaaaatagagtaagcggttagtgctattcatttccctctgattcactgctatggctgcatcccacatattttgaatatgttttcaacatatgtttttatttccaattatgtgtatttttacattttctttgagaaaactttctctttgacccattgattatttagaagtgttgttttatttccacgtttaaagctttttcctgttgtgtttctgttactgtttcctagtttgatttcattgtggcagagaacatactcacatgattacagttattttaaatttcctgaggcatgttttatgacccaagatatgatcaaatatggtctttcttggtgaatgttccatgagtgcttgaaaaaaaaaaagtttctgctgagggttgggttactgttctgcagatgttaatcagatcctcttagattgtgttgttcagatcttctttccccttgctgatttactatttagtatttctcagttgctgagagggtgctgtgatcctcaactataattgtgggcttgtctaggtctctttacagctttatcaatttttgttttgtgcatttttgaggctatggtgtttggtgcatatgaacatttatattttaagtatcagttatattaagcatatcttaaaatgctgaaaactctatttctagatattatctatgtagacagcctgatacattttatagtagtaacagaggaagttgactagagacaaatttaaaaataaaactttcagtatagataatgcagaaactattggctgggcatggtggctcacgcctgtaattccagcactttgggaagccaaggcgagcggatcacaaggtcaagagattgagaccatctggccaacatggtgaaaccccatctctactaaaaatacaaaaattagctgggcatggtggcatgtgcctgtagtcccagctacttgggaggctgaggcaggagaatcatttgaaccagggaggcggaggttgcagtgagccgagatcacaccactgaacaccagcctggcgacagagtgagactccatctcaaaataaaaaaaaaaagaaactattatcccaacatattattttctgtggttttttttaaatatatggagaactgatggtgctacgtttttataaaatactctttttcacataagataaatagaatatataataacttgctgacatatcatcagtaaagacttctaaatgataatgtaacatctctgaaacatatcttataaacaagagaaaaaaagagtagaaccaaaatgaaactttaaatttaattacattaaaattaatgttttgagtaggttttgttgaataactagtaggcttgacccttggctaaaaaataattttcttcacgaaatctacatacagcacttctacctttcttatatttgccacatttcattttgtgttatagttacatgtatgtttgttttaatagtattactacattgtttgtacacagccacatgtatggtatgctggttttaaaacatatatttacaaagtcttagatactcagcaagtggagtttattccactcaccccgcaccccccactgttttaatgtgggcttagtgactcacttctttttaaaaacaaattttatttaaaaaaaaaaaaaaaagaccaggcatggtgactcatacctgtaatcccaacattttgggaggctgaggtgggatgatcacctgaggtcagcaatttgataccagccttaccaatatgacaaaatgctctctactaaaaatacaaaaaaattagctgggcatagtggcatgtgcctgtaatcctagctactcaggaggctgaggcaggagaattgcttgaacccgggagtcggaggttcggaggttgcaatgagctgagatcgtgccactgtactccagcctgggcaacagagaggactccgtctcaaaaaaaaaaaaaaaagagacaaggtctcatattgtccaggctggtcttgaattcctgggcttaagtgatccacctacctcggtcttccaaagtgctgggattgtagacgcgaaccaccacgcctggccattagtgactcacttctaacaaacagaataaggcagaagtgatggcgtgtcctgcagatttggtcatgcatggccctgtgggttccttgttctctcttggatcactcgctctggggaaagccagatgctctgtcatgagggcattcaagcagcaccctggagtggtctatgtggggaagaactgaggcctcctgccagcagccatgtgctggagttaacctgagagcagatcctctagccttggatggaccctggatctaaacctcacaccttatacaaaaattaactcaaaaacgtatgacacttaagtataggtgcctgtagttctggctgacgtcttgactgcaacttcacaagaagtgctgaaccagaaccccctcaactaagctgcttctagagtcctatttattgtgaggaatattattttagagactttgtgaaataataaatgtttatttttgtttgtttttgtttgatacggagtctcactctgtagcccaggctggagtgtagtggcgcaatctcggctcactgcaagctccgcctcccaggtcctggtttaagcaattctcctgcctcagccacccaagtagctgggattacaggcacacgccaccatgcccagctaatttttgtatttttagtagagacagggtttcatcatgttggccaggctggtcttgaactcctgacctcgtgatccgcccaccttggcctcccaaagtgctgggattacaggcatgagccaccgcgcccagccaaatgtttattgttttaagccaccaacttttgttatatagcaataaataaataaataatgaaataggctgggcacagtggctcacacctgcaatcccagcactttgggaggctgaggtgggcagattgtttgagcccaggaggtagagaccagcccggggggtaacagagcaaaaccctgtctctatgagaaaaaacaaataagtaataaaataaaatataggctgggcacagtggctcacgcctgtaatcctagcactttgggaggccgaggtaggtgaatcacttgaggccagtagtttgagatcagcctggccaatatggtgaaacgctgtctctactaaaaatacaaaaattagctgggcatcctggcatgtgcccgtaattccagatacttgggaggctgaggcaggaaaatcacttgaatccaggcggcagaggttgcagtgagccaagactgtgccactgcattccagcctgggcaacagagtgagactctgcctcaaaaaatacatataaaataaaaattttaaaaataaaataaattatagaaaagaccagctctttagggaaaaaacaataaaattgataaacctctagcaagactgacagaaacaaaaagcaaggaaacataaaaaatattaagactaaaataagggatatcactacagaccctacagtcgttattagtataataaccaaatactataggcaattttatactctgaaatttgataactcagaagaaatgggcaaatacctcaaaaaccacaaatagccaacacggatgaaacaggcaatctgaatagccctattaccaatttaaaaaaccaatatctaatttaaaaactcccaaaagataagtttccagggccagatggtttcactagagaattctaccaaacatttaaagaagaacaacgccaataaaaatccttgcaagatatttgtagatatagacaagactattctaaagcttatatggaaaggaaaagaaattagattagctaaaacaattttgaaaaaaataaaatggaagaaatcagtcttctggatttcaggacttattatatagctatgattaagactatgtagtattggcaaagggatacatataaagatcagtggaacccagaaataatcctatgcaaatatgcctgggagccaggcatggtggcatctgccttctacctatatcatatatgtccaactcttttttcataaaggtgcaacagcaattcagtagaaggatagccttttggataaatggtgctacagcacctggacaatcacaggcaaaaaaaaatgaccctggatctaaacctcatgccttatatgaaagttaactcaaaatgtatgacacttaagtattataaaattataaaacttttaaggtaaaaaatgagaaaatctttgagctctcaagctaggcaaaaatttcttagacctgacactaaaaggacagttcccaaaaggaaatattgataaactggacatcatcaaaattaaaaattttttgttctgctaaagagctgtgatgaggatgaaaagacaagctacagaatgaaagaaaatatttgtaaaccacatatctgacaaaggactagaatatacaatgaagtcttaaaattcaactgtaaaaaaacaaacagcccaagtaaaaaatgaacaaaagacagacatttcattgaacaggatattccgatggctaatggaccacaaaaagacattcaacatcattattcctcagagaaacgccaattaaaaccacaatgagacatcactgcatacctgtcagtgtcatacctatttggtgacagcaccaagtgtggagaggatgtgaaaaaattggatcacttgtacattgctgggaatgtgatatagtacagccactctggaaaacagtttagcagtttcttaaaatccaaaacacgcaattaccatacccagcaattgcactcttaggcatttatcccagcaaaataaaaacttagggccgggcatggtggctcacgcctgtaatcccacactttgggaggccgaggtgggcggatcacctgaggttaggagtttgagaccagcctcaaaatggagaaaccccgtctctactaaaaatacaaaattagccaggcatgtggtgcatgcctgtagtcccagctactcgggaggctgaggcaggagaattgcttgaacctgggaggcggaggttgcagtgagccgagatcatgccattgcattccagcctgggcaaccacagcgaaacttcatctcaaaaaaaaaaaacaaaaaaacttaggttcacacaaaaacctgtacacaaatattcatagcagcttaattataatatccccaaactggaatcagcccagatgttcttcaataagtgaatggttaaactgtggtattcaccccatggaatattactcaataataaaaagaacaaactattgatacatgcaacaacttggatgtatctctaggaaattatgttgagtaaaataagccaatcccaaaagtttcattctgttttgggttttaaattccatttatagaacattttaaagtgataacattttaaaaatggaggatagatcagttcttccagcatctggggaccagtagaggggctggaggaacatgtgtgtgattataacaaggcaacatgagagagtctcctggtgttggaaacgttccatatctcaatccgatagtagatacgtgaaccaatgcaggtgatactgtacagaacttaatatgcacaaattcaaataaaactggggacatctgaataagatcagtggattaacatcaatgctaatatcctggttatccttctataaaatattaccatttggggacattggacaaagtatacaaggcacttctctgtaacaattctcataactgcatgtgaaactataaataaaaaatattaaagatgatgtgaacagagatacacacttttaggtggctgtatttttccccccacaggagtcatacttaacacaatggccaagctataaaaattgaatgagaggaactgatgtcctagggttacttatcaacatatctaaagtaaaataaatacaagcatagtttttaaaatttcaaagctctataaaatgcaattttacaaggttactaaatgtgcttgttttcaggatcctgaaggcaatttcctggtatcaaaacccacatatcctttattgagaatgacttgcacaacactattctgcattacatgggaataaaatgatgggtggttttttccgagagaacatatccaggagcaacgacgcacctgcagttggagcagatagtcgctatactttcaccgcatcaccactagatttccatgaattctgcatgagaaaactgtgactgatatgtcagttttttcacttagtttatagtacacgcaaaaataacatggccagtctcttgccatgttatttccaaagaaaattacttggaaaatatacctttcaccaaactctaaatccatgtgcaaaatgtaatattttatacaccatataaaaataccaaaaaacatctagcagtaccaaatcaagatgagacacaagagagggatcctatgcactggtagctgcaggatggcttctgtagtaagttgtatggtgtggtctccaataagatatgtcctaatcccagaacctaggaaggtgaccttattggaaaaaagggtctctatagatgtaagttaaggatttggggctgaagagatcattccagattatccagatgggccctatgtccaatgataaatgtccttataagagggaggcagaggaagattggtccgagacaaaagaggggaacgtgatgtgaagagggagggaaagattagagagatatgaccacacgtccaggaatgccagggcatcaccagaagctgggagagacaaggaacacattctcccctggctctccctcagggcgtgtgaccctgccagattttggagttccagccttcaaaactgtgagtaaaactatttctattgctaaagtcaccaagtgtgtggtgatttaggatggcagccacaggaacagtttgactcccttcacccggagtacaatccacgcacctgccaatcaaagcaacaaagtatgaaaatcactactttaaaaactcaagacaaaagaaacctcaaaaatactagcttatgtaaccatgagaccttcaaactggccttgaattcagaataaacaagaaacagccaaatagaaagctatcattgaggaggggaaaaaaaaaggttagaaacaactaacttttaattctgttcaaagagaagcagtactaccaagatatcaaataaataattcctttaattaataagcaatctgcaaagaatgagcataaaattgtgaatatgagttaatttgatacttccactgtataccagaaacactactttaaaatataatggaaaaaacactcctttcacaaaagtaatgaaaaatatgaaacatagtttcaagaagtaactttaaccaaccttgcatggacctatatgaaaaaaaaataaacagcttttattaatcattgtttatatcttcaagaacacttgaacaagtgggacctgcttggttgttgggtagaagattgagtaactgtaaggtacaagttagtctcaagatgctgacaagtttgacacatgcaaaaaaagtcccaaatatattttttgagtgaagttaatcaaataactccaaagcacaactggtatgaaaatctagtgagatcacaacacaaacaatagataaatgtttgaagttatagatatcccaattaccctgatatgatcatgacacattgtatacatgtatcaaaatagcacgtgtagctccaaaatatgtcaactattccatatcataattaaaaaaataaagtgagaaagaaaagatttattaacacttatagccaggtgtggtggctcacacctgtaatcccagcactttgggaggccaaggcaggtggatcacttgaggtcaggagttcaagaccagcctggccaacatggtgaaaccccgtctctactaaaaatacaaaaactagctgggcctggtggcacgcgcctgtaatcccagttactcaggaggctgaggcacgagaatcgcttgaactcaggagatggaggcttcagtgagccgagataacaacactgcactccagcctgggtgacaaagcaaaactccatctcaaagaaaaaaaaaaaagacttataaagtaaactaatgggcatagtgatgacacggtctgctaaatattaaaacaggacataaaggtacacttattaaaacgtaaggaacaacatacagctgcacgaagcatatgtccatataggaacttgtatgcaaacattcacagcagcattatttcataagagccaaaaagcaaaaacagcacaactgtgcttcagctgatgaacagataaataagatgtggcatatccatacaatagaatattattcagtcataaaaatgaatgtagccaggagaggtggcatgcacctgtagtcttagctactcaagaggctgaggagggaggatcacttgagcaccgggcaacatagtgagaccctgtcactttaaaaaaaaatgaggctttcctctttacttctacaggtattgatacataatacaatacaacatagatgaaccttgaaaacattctactaagtgaaagaagccagacacaagagaccatatattgcactattccattaaaatgttcagaacagataaatccgtgagacagaaagtagattagtggttgccagagactgggggaagggggaatggggagtgactgctaatgggtatgaaagccttttgggtgtgatgaaagtcttctggaattatagttatatttttaccttgtatcatgtcaagaaataaacttcagatggagtaaagatttaaaaatagaaaataaagtcatgaaagaacagttggacctccgtatctgtgagttctgcatccgtggattcaactaacaacagatcagaaatatttcttaaaaaaatatgtgggtgcggccaggtgtggtggctcatgcttataatcccagcactttgggaggctgaggcgggcagatcacgaggtcaggagatcgagaccatcctggctaacacggtgaaaccccgtctctatgactgtgccactgcactccagcctgggtgacagagcaagactccgtctcaaaaaaaaaaaaaaatgtgggtgcatctgtaccaaacatgtacaaactttttttcttgtcactatcccctaaataatacaatataacaattatatacagagcatttacattgtattacatattataagtactctagagatgatttaacatataccagagggtatgtgcaggtcatatgcaaatattattcaattttatataaggaacttgaacatccatggattttgatatctgaagggggtcctgggacaatcccccatatataccaagggacaactatactataagaaaataaagaataatatttctataatcttatattggggagtccagtctaaatatgacatggattagagaagttataaaagacatacagacttaagcatataaatatgacaagcttccagaagatgagagacttcttgaatggatactgttttttttttttaaggatgtttctatttacatatcttacccatttcctgtttagaaaaaaaaaatgcagctcgctgccagcacacatttctcagggcaaacaggaaatgggttaaaaggcctacgtatgtagtagacacctgctgggtggtctcctgattcaaccattctttctcttatattacgtggatcgggcctcaagccttggtcatctttcttcttgccacatggacaagaagcgcagggaaggcctttttacagacaaataagaataaaatatgtatgtgaagagggcagacataaatgatgcagaactgaatactgatgtcatgcaaattctctgttccagcctttttccaaggccaatatgcattcttgcctttggggactgggagacactccaatattcctctatgggtttcttctcttacttaaaagatgtttaaatgagtacattttattatatttaaaatgactccattttttgagatggagtttcactcttgttgcccaggctggagtgcaatggtgtggtctcagctcaccacaacctccacctcctgggttcaagcaattctcctgcctcagcctccggactagctgggattacaggcaccagtcaccatgcctggctaattttttgtatttttcgtagagacggggcttcaccatgttggccaggctggtctcgaactcctgacctcaggtgattcacccgcctcagtctcctaaaatgctgggattacaggcgtgagccaccgcacccagcctaaagatgaccccatttctttaactcagtaattctgccttcaggactatggaaacaggccagctgtggtgtcttactcccgtaatctcaacactttgggaggccaaggtggatggattccttgagctcatgagttcgagaccaacctgggcaacatgtcgaaacttcgtctctataaaaaatacaaaaattagccagatgtggtggtgcatgcctatggtcccagctactcaggaggctgaggtgggaggatagcttgagcccaggaggcagaggttgcaatgagccgaaattgcaccactgcactccagcctaggcaacagagccagaactcatctcaaaaataaaattaaaaaatatggaaacgctgcaggtataaatattaatccaatgattatatactgagtccctagtatgtgccaggcactgtttaaggccatgtggatacagtgcttctgaagacagatagccactgaagaattattgctttccttttttttgagacagggtctcactctgtcaatcaggctggagtacagtgccacaatcacagctcactgcagcctcaacctcccaggctcaatcaatcctcccacctcagcctccgagtagctgggactagctgggcacactccaccgtgcccagctagtttttgtattttttttgtagagacagggttttaccatgttgccctggcttgtctcaaactcctgggcctaagtgatcctcctacctcagcttcccaagtagctgggactacaggcctgtgccaccatttttgtatttttggtaagctaatttttgtatattttttgtttttttgttttgccatgttgcccaggcttgtctcaaactcctgggctcaaggcatcctccagcctcagcctcccataacgctgggattactagtacgagccactgtgcccaacctgaagaattatttctagcaatagaaacctcttagacagatggatgtccaataactgaggattgattgtggactatttaagtgacattagttacattaatgttacttaagcattaacatgctatttgtaataacaaggaaaaagtatgttattttgttaagtgaaagaaacgattaacttatagtttaatcataactatataaaacattttaaacctatatatagaacaaaaggtcggaatgatcaaagtgttcgcatctattatctttgactgatgagacactatggtagtatcttctgctgtagaaaatatccaaattttctattataagcaaacctactttggagaataaaataaaacaaagtcaaatattaagaagagctttgggaaaacagaacccaaagtgcaaggcatcagagaggtctccatcatctgattatgaaatcttggactctgaccccgcagcaatctaccagaaactctaggcaacaaggatgggacttcccaccccatgcacagaggtggccccggtaagaaggcagagtttgacagtcattgtgggtgctcccacccacagctcctgtcaggaagtggctgtgaaaccgggttcctcagagccatcgtggttctctggaggtaatctgggttggggagtggctggaggaagtaaataggggtccagcttcctttgccttctcagcctggtcctctccatcacaggtagctttccacaaactctaagttgaaaatacaagcagcttcttccgagaattgttcttgctctctagagaattctcttcattaacgctgttagtatcccttgactggaaggcaccatagcatttatgtgtaattcctgaatcacctccatgattttcagatattttaggaaccgggatgttttcctcaaatgaaatctcctgtgtatactcaggataaaagtgaaagaggggagaaaaggaaaaaggaggccttgtgctgctgtgaaacccaacagctctgaggaaccgggttcaaagccacttcctcaaacaggagctgtgggtgggagcctccacattgactgtcagcctctctgcattcttactggggctacctctattcaaggggcaggaatgcccagaccttctgcctagagtttttggtggattgtctgggagtcagagcccacagagtctgctgccagacctgaccacatcccaaactctgactcaggagtaagcgctttctttctctccccctggaatcctgtttcactgtttaagtgttattgcacctccccttctgcactcctgttccctggttccagggagcagaaagtaattacaggacacctatgctgtccattccgtcttcaagtagtccagaggcacccttggatttgcacagttatacttaaaaacccagaagacacttcgcccttgccctaggatcaccccctcaactccctagtccctggcaatcattagtctactttctgtttctacaaatttgctcattctgaacatttcatataaatggaatgatacaatatgtggccttttgttactcacttccttcatttaccctgagttttcaaggttcccccatgtggtatcacatgtattaatacttcattactttttatgggtgaacaatagtatggatatactatggatataccacattttgtttgtctatttttcagctgatgaacaattaggctgtttccatcttttggttattaggaaatgcaggcatacctcattttgttgtgctttgatttaatgagctttgcagacactgagtttcttaaatggaaggtttatggcaaccctgtatctagcaagtcgacaggcaccatttttctaatggcctgtactcaccttgttagcgtttcttagcaaaattttaaaattaaggtatgtacattgttcttcttacatgtaatgctactgcacacttaatagactacactatagtgtaatcataacttttatatagactgagaaacgaaaagaattgtgtgattcacattattgcaaaacacaacatttgttttatcatgatgttctggaatggaacctgcaatatctcaggtatgcctgtaatgctgtgaatatgcatgtatgcattttgtgtggacatatgttttcaattctcttgggtatatacccttaggaatgaaattgctggttcatatgacaactcttatgtttaacatagacctgcaaactgctcaggaactgcaaattattttccacagcaatgacactattttacattcccaccagcacgcatgagggtcccaatttctctacattcttgccagcacttactattgctcttctttttgattacagccatcttagtggacgtaaagtggtatctcattgtgattttgatttgcacttcctgacgattaacccatttatgagggaggttgcaattttttgaattgcagacgtgtgaaaaatcagaccttggtgatgaccttgagcagtaggatataaataactcccacaggtttagcattccagtagtggaacgctaggcataaatgggattcaacgatactggcatcttttcatgtgcttattatctatttgtatgttgcctttggagatatgtctactcaagtcctttgccactttttaattggcttgtcttttttttgttgattcataagagttatttacatattctggatattagacccttttcagatataggatttgcaaacattgtctcccacactgtgggttgtcttttcaatttatttattttgtgatggggggagattagggaatacgaagaatgcctgttctctttactgacggtatcatttaaagcacaaaagttttaaatattgatgaagctcattgtacctattttttttcttttgtcacttatgtttttggtgtcatatctaagcaaccattccttaatccaaggtcatgaagacttactcctgtgttttcttctgaaagtcttacagttttagctcttatgtttaggtctatgatccattttgagttaatttttgtgtatagtatgaggaaggggtccaacttcattcctttacaggtagatatacacttgtcccagcatcatctattgaattctttagttaagaagcactgaatcctagtccaacatcttcattttacagataagaaaattttggcccagaaagatcatgttaaaattactttgtgttgagaataaaagaaaatacatctgaaagaagatataccaagtcaataataataacaacaaaaaaagaacatacagagaaagagaaaactttttgtttctgttcttcagaatttctaagtccagtgagagaggtaaacagtacaacatgggatgttcaggactaatcacagaaatatacaaagtgggggtgaaatcatagagaaaagcctgcttaactgcctggtgatttaagctaagattcaccagggaggatcattctaggcaaaacaaacaaaaaaaaacccctcgtatacaaaagcctctcagctggaatgttatgggaagtgtacatgtggcaagatcttaagttgaggcaaaaggaaagcggagtgatgggagccaaagctgaagcagacttggagccaaacaccaggctgcatttgcccttgggaggtaggcaataggtttttttcttttcttttttttttttttttttgagacagagtctcgctctgtcacccaggctggagtgcagtggtgcgatcttggctcactgcaagctttgcctcccgggttcacgccattctcctgcctcagcctcccgtgtagctgggactacaggtgcctgccaccacgcctggctaatttttttgtatttttagtagagacggggtttcaccgtgttagccaggatggtcgcgatctcctgacttcgtgatccgcccgcctcggcctcccaaagtactgggattacaggcgtgagccaccgtgcccagctggggatcggtttttataacaaggcaatgacaccaccagatctgtgctttagaaatctgattgcttgtctgggcacggtggctcatgcctataatccgagcactttgggaggccaaggtgggcggattccctgaggtcaggagttcgagaccagcctggccaacatggtgaaacccccatctgtactaaaaacacaaaaattagctgggtgtggtggcaggcacctgtaatcccagccacttgggaggctgaggcaggagaatcgcttgaacccaggaggcggatgttgcagtgagcccagaccgtgccgctgcactccagcctgggcgacaaagcgagcctttgtctcaaaaaataaataaataaataaatctgattgcttgcaatatggacgatggtttgcaggaggtagaggctggaggaagggtttaggtgattcttgcaaaaggtcatgacaagagcctaaaaacagagtcctcagctcacaacgagttctcagatgcggctggcagatatgtgttgtttggctagaacagtgtttttaaagcatcttgaattcctgattggggaggaggcagaggcaagctctctctggggtgtcacaaccacaacactccctctttaggctcgcccaggcagaggcacccatttatgttaccagcctggccctggtaagcatttcagttgcaacctacgcctaaactaaggcagtgatgatgtagacagagaagagcacatgtactctcagcacaatttagaaagtgggctggcagtgctgctctttggtggtagagaacacagggtgatgttcgtctctggacttcaatgtgcctaactcacaccccatcccccagaatgatgacaaagcttttgctgaacttgctactctgaacagtttgccctcctggttcatggcctctcatggaagtaacaaaaagtacatagtcttttaaaatgtcttgggagctgtgttttctttcctgctgaagctttgtaaagtagaccttccaattctctaggaagcaaaggttcttttaaaccataggcttcaacttcccaaagttgtttaaggattctggtgctagccaatgatacagtattacttttgtcttcaactggtatctttcaaaggatttatatttctcaaaattaaaaagttgtacccggccgggcgcggtggctcacacctgtaatctcagcacttcgggaggccgaggcgggtggatcacaaggtgaggagtttgagaccagtctggccaacatagtgaaaccccgtctctactaaaaatacaaaaaaaaaaaaaaaaaaaaaaaaaaagctgggtgtggtggtgtgtgcctgtaatcccagctacttgggaggctgaggaaggagaattgggtgaacccgggagtcagtaccctagttccaagacaatattttattttcttttgaacttcattcactcaagtctttattcagagtgtaagttcctagagggtggggactgtgcatctcatttagcttagtaactcaagagcttaacaaagttcctaacccatggcaggggcttattgagaattgtacaggtttcctaccgtcaacactgttatctattagctcttttcagcttcagttacctgcaagcatctgggccgggttcaactgcaaaaggatctcacccatataagaggaaaaagggcagtagaggaaggaacctggaagttgacctctgcacatttctggatcttttttgtggtgctggcatgttgtgggcctggcaggaacaggcttccagttcctgtctgtcttatcactatctccacctttcttatcagttagctacgtggggggctttctgtcctacagatcctttatacttggcacgcttttttcttggccttactcagtactgagggtgaacatttgtatgctactatttattttaagtgttttgctttataaagacctatattctgttggtaaaactgttttctaaaattaaaacatatttattgataataaaaggcaaaattgcagctaaattttcttcttctgtgggagtgacacactaagagtacccttccaattctgtgatttgaaggttcaagaaaccacgaacgttcctgtgagccaaaagctttataatttgcttgagttgaaaatctacaagtgaattttaacaggataagcaatccgtaacaggaccaggaaactattcaaggacaagaatagactgtttttcttggttttagctacacaaatcaacaccaatccttctgataagacgagaattactctttcaacagttaccgacagtagcaaatgccacgaagatattaacaaacagcaccaatttaaagcctaagagcatggggaatgcagctggtgattcttacaaatgttaatgtaaactctgcagtttattccactccacattgctaaaaattttaccctgccaggcccactgcaacctcaaaataatactcttcccaacataaagggctgcttcttttaacttctccagagtgatttttacaaggaaggaaagttgccatatctctaagaccctaggggagtttagaatatgatcaagttccgaagaagtgcatttttgatttgtaaaaattattttaacaaatattggtcaaatgagtgaactgcattcatgtgcataaatatgtagaacatctgcaaacctctcacatgcatccagaggaatactactctcctgaggaggcttggagcaaggaggcctagcaaagatggacatgcaccgagcaatgtgcgggatctgggctggacaccatgataaatatcaaatgaaccagagggtccattaaaagctggctggagaaaaaagtcacataaagcgaggtgaatgtggaaaagtgaggggtgagttaagacaagctgaaaagctaaagaaatagaagtagagtgtttaagagaaacatgtacccagttttattgagatcaattcaaatcgccaggcactgtgctaggagacagggaacacaagctatttaagagaagctttctgcccttgattgtaatgagacagaaataaatctgcaattaacaatcataaaggcatactttcatcttgggcacttggaagaaaggaaacatagagctgacataaactttgatgtaaatgcagctttaagcactttttctttttctttcagtgatatggcaccttctccttttcaaaaatagcagcatattaattctctgttaaatcttttctttgaaatttgcgtttatgtctggcatgattttaccccatgtcacctggtcctgctccccgcattcttgttccttctggcaacacccacccaaatttcaacacatttttccgtcacaaatttagcattagcttaagtcattaactatatttacagcttgtcttcatccttactgaaacataaaggatggttgcaataaacagtgtgttttgtttatgaagaaaaatgtccattttaaatcagtctgcttgaatacatcatttctgtatttgaacatggctttggcagatgcagggaaggatgaaaactccacactcactggaaaacaaataggcagcattcttcattttattatgtgaactccccacacagtatgtcatgtggaatttgtgtgggattttatttactatatcacaaaagctgtccttactgtatatttatgcagaaaaaaaacaggctgcttttatgtaagtcaaatgtcacatcagaaaataataccccggaatgtctggaaagtattctggtgtttttgatccattaaaaaatataatttgtctttcacaacaacaaattaactgaaggggtaaggtatgtttaataaaaaataacgaggccgtctggctggagaccgagctgtcaggaacctggagaaggagatctgcaggctctttccaggggccgccctaacctgagacaaccaggaagacagcgggatggcccccagcacacaaggacccacaagagccaccgtcaccctgagcactcagaaagatactcagactgagcctgagcgcgtcttcactcagttccagtttcattcacgtgggtactcaaagatgcctatgcttccagttgtttctgtgttctctgtgttctcctgcagaatccattgaactggacttaagacatttatttcagacaaataagataaattatgtagtatataaaatgtaaaaggtggaaagagcaatttctgactgacacaggaacattcctggacacgagaaaattcaacccatcgatgttgagcgagactcagaccagacatgctgtttgtggctaatattagaagtcatttaactgtcaaagcaaatggcactttatgagcaagaaatcaactgaaaaaaatgaattatttatggttttgataaggtcataaccatcacaaaaggcaacaagggcaaaacagtaaaactgtctgttcaagtaaaagcagccctccctggaagaaggtaacttgcttcctgtctcactttcacattgggccttgctggctccaacgtggcccatgtgtgctatgtcaggggaagtatttctttcccttgccactatgtgggagcttttaatacagttctcaactctctatgagctccttgggtgtgtatattcccttaaaaattatctcagtgtgtaaaaaatttgttttaaaaacattttaaagaagaattggctgggcatggtggctcatgcctgtaatcccagcactctgggaggctttgggaggacatggcaagagggtagcttgaggtcaggagtttaagaccagcctgggcaacacagtgagaccctgtccctgcaaaacattttaaaaattaaggctggacgcagtggttcatgcctgtaattccagcattttgagaggccaaggtaggcagattgcttcagcccaggagttccagaccagcctggacaacatagcaagaccttatctctacaaaaagtacaaaaattagccgggtgtggtggtgcatgccagtagtcccagctacttgggaggctgaggtgggaggatggcttgagctcaggaggcagagaggttgcagtgagctgagatcacaccactgcactccagcttgggtgatagattaagattctgtctcaaaaaaaaaaaaaaaaaatcagctgggcgtggtagtatgcacctataatcccagctactcagaggctgaggtggaatgatcgtttgagcctataagttcaaagttatagtcatgttttgtgccattgcactcagcatgggtgacagagtgagaccctctctcaaaaggaaaaaatcagcggcaatagctcctaattccctctttgtaattttccgggcattaaaaataactggtcagttaggaggtggctaactctgctcaatggttgtgcaaaagcttaggataaaatacagaaacaggagctgaggaggcttctttcccttttcagtgttgtggcttcatataaaatctacatgtgagctctaatactggtccacgcatgcctgtgtggctctcagcgttctagaggccaaggctaagctcactataatataaatgaataaatgaatcaggactgttgagttctcctttcaatccccaagtcaagcacagtgtctaccacataatgtcaaataaatatttatggaaaggaagaaagggaaggaaaaaataaaccaagagaatgaaacagttagatcatgaatggcgctggtatccactgggttcccgtatttcttaagaaaatgaaccctctaaacaaaatagcccaagttttaagtttgttgaaacttcccttaaagatcagttctggggacataagagaaagattttgctactgctaacaaagtttgcaaaactttgaaaagaaaggttttggcacaggcaaaatctgaaaagagtaataatgagcagaaactggccctagcagacagataataaatcttcacattctgaagcttccatattaaaagtgtggaactggagaagaaataatcgacacagctcaatggatcacaacaacaaattaaaaatatataagggaatttcattttctataaaggtatacaataaaggtatattatattattataaaggcagcatttcaagaaaagagattgcttaataaatgtgtttcatgcaactaggtaaccatctgagaaaaataaagccagattccgatctcactccttataccaaaattaatttcagatgaatcaagttttccaaatgtaaaaatgaagccataagagaaagcgagggtgaacagcgaatgtgtgagtaatctcaaaggggcatggtctctttctatgcaggacacaacagtcaaacaaacaacaaacaggaaaaatatttcaacacagctacaaagggctggcttccttaatttagagagatactgtttatttcatccatcacactggcaaaactctagggagggcctgggaaaacatttactgagatactattgaagggagtgtgtgttagacgtgacatctctgggagatttggcagtgtttatcaaaatttagaaaacatgtatctcagcaatccctgagccacaaataatttatcctaaactcccactacccaaggttctgcactaaggtccagattccagaagaagtaatgcaatcccaagttcatccttcctactgtggtcaaggttaaaccccacaccccacgatgtgactgctgaggcgacttatcagtcccttgaagccaaatcagacaggcaccttacagacaccgcatcacccgctgccctgttccacctgccaagggtctgtgcctcctcactagactccagcatcttgaaggcagaacgatatcctttcccctgtctttctttctttctttctttttttttttttttttttttttttttttgagacagagtctcactctgttgcccaggctggagtgcagtggcgcgatctcggctcactgcaacctccacctccctggttcaagtgattctcctgcctcagcctcccgagtaggtgggattataagtgcccaccaccacgtctggctaatttttttgtatttttagtacagatggggtttcaccatgttggccagactcaccatgttggccagactggtctcgaactcctgacctcaggcaatccaccaccccgccccccaccgcccagcctcccaaagtgctgggattacaggcgtgagccactgtgcctgtccctttcctctttctaatatcacatttatatagcccagagcagaggctcaaaataacattagatggatgaacaaataaattactgaatgtgtaaatcagataaactagctagctagaagtactagtgggcaggttaaagacaggatggaatcataggtaaatggttaagaaaaaaaagagaaagggatccaagagtttagaatagttttctaataaatttaaggttagtcctgtgtgtaaaaactatctttatattaagtatgcaaaattatcttataatacacagaggaaccggagcagacaataatgaatgtcaggcatttagcaagctgggttagatttgatgaaaccgaaaactcttaagcttggaaactagcttgttaaataacaatgttcctgtaaacaggcaggctagatttattgtgcccctgggaaattctctggaatgaacacagaaaatgcttctgttgattagcctttttagcttgcgggtgagtgttgacctaaaagggaaaggcttgccctccagattttacataatgtgcccttatcaattcctgtcaggagaactgtccctgcagggatgttaggaagactaacgattctgcctcagtaacacaacctgtgctcccaggagcctgctgcgaaacagcagcttatctcttacacctgcttatggactagaaagaccaattttaaacagagggccaatgcaaagagaagagaagataaaggacattaataaagctaacaagttgattgatatattcaaagagaggaaaccgaggccgagcatgtgtgatcactggcccaaggtcacgagggaactggcggccagccccaggacacagagggcttccctcctccagccacctcctcaacgctagctggagagcagggaggaggcatttcccagaggcaagctctgaatactccgctgtgttctcactggacaaaggaaaggaaagatactcctctaaagacggcactgaacactcacttagagacggtaacagaagcctctgtcagcaactcaaggctcatttaaccaacttttgggatattacccacacagtcctaaaaacgtatgcaaagcaggaagtgagataaaagagacctcaaaaattctgagagtaactataaaattagacatattaataaacgtgcaaacgttataaaatgggaaaatatatacagttggtttttccggctgtggtagctaatcaaaaatgacatctccttccagctcccctcactcccaccatgccctcgtgggcaaaacctgctatgatttgcccgtgtagccccctctctgtgaacgtaggagaagcgaagccattggctttctgagacttgctcatcagaagccttgctgctgccacctgcgcctctgggaaagcttgccgtgggagaggcgcaaccgcctggagaggccttcctatgaggaagtgcgttagtcacgtaggagacggccccagctggcccggccacccagctgaggcgccaagctgcacgtgaaaaagccgtcttgggcatacagccccactgggcattcccgtgagtccagccctaacgtcatcggactgcagccccaagagagacccgagggagaactgcccactcacagaaccaagagggagaatgatcaacaatccacaaagtttcttgcaaagcaacagataactgaaccattggctagccaagctgtacaaaagcattaaaatagatttattgccataagacatgagaagtataaacaaaaaaaagttactaaacaattacagagcgcctatgcctcttctttgaatggaaggccttagaaatacttccatattttctgaggtattttgaaggagtacaggtctgaacacacagcacacagctgtcagaaggaaggccaggcatttacacagggtgggctgtggaagaagaaacctcgtaggcagcgggggacacaatggtgactgcaggaaggcctatgaggctgtcagctggaagactccttgataccatttcattaccagtccaaaacacagtcagctctgcttgttttttctcttacaaactctagtatgctgtagggttagagaggtacttatattgtaagcatacatgtgcaaataactgtgctagattatgtggcaacctgattttccctagatttgtcatcttatatttcaatcagacatgatgatgaagagccttgaactcaaattcaaatttaaaacaaagatgaaagcacagactagaacagaaaatcaaaaacacaattcaaggatagtataacaaaaacatatttcagatactgaagaaagctggtcctttgcaatagaccatgttccacggaggtctgccctctgacaagccgagggccttaaggcacataacctctttgagacttgagatcttcagaattgttttgaaactatttcttcattgggaagaaaaaatggttctgtgatcctcaatggtggtgaagttctaggtaagagctttaagcgaaacgatggaaaaaagcaagaactaggagctggtacgttagaagcatctactgcattcaaaccctgcattaggccccttcatacaaacctcctttagtcctcgtcatggccctgcaccaagggcttggtgtcccctctttggagaagccaccacacagaaaggtccagtcaccagcaagaggtcgtgcggcacgtccactctgagtgagtctcacaggggatctcaaatgccctctttcactctgcaaggtattacctgcactgtgggctcagcattccagagatacgcatgggaatagggccaggtccctgcctccaagagctgacagaaggctggaacaaacacacatgtgcacgcaccattcatttccacagaaagtcatttttggattcaaagctgcgtttgaaatgggtcttgcaggatgaatgggatttcacagatgaaaactggtagaagaaaactgcataggctcatggattcattcagcaagcacacacacaaaggcctgctgtgggtgaagggcaaattctgtccctgaagggcagagtgagtgctgggagcttcaagcatttcttttgaggtccgtttagcaaaagaatttcttattaaatagacaactcactttatattttgtcacatacactaaacacttgtgggaaattctctctgccattcagattttaaaaaattgattctggatattagctgttcccaaattcaaaggcgacatccctcacagcaaaaacctaacacaggtcctggaaaccgacaaggccctgctgcaggagctcacactcctgcggtccctactcccagggatcaagcctggctgctacaactctgtgtgcaagagcaaactgtttcttgtgatgagtcagtttcttttttgaatcaaaacagaaatgttaagaaaatatggagagctattcttttatgatcaagacaatttttgctatgctttatattcttttacagtttcctattttaatattctcatctggtagatttcaagcactgacctctccctttctttcaacaagggtataagaagacagactccacttgctcagactaggcatggggctttatggcctttgggatttcttaggggagacttgagacttgagagctggagaactgtcaagctaatgatgtaccccttttccttgccatttcaacacgaacaggtatttctctccaaatctagaaatccttctgtaaatggaacggcagatcattattttgcattttgctgagaacaagaagtacgtgagatattgcacaaagtacagcatgaggcatagcttttacccaacaggctcaaaactctaaattaaaagaaaacaaagggacagaaagaaaagcagttttcttctcttccacctcctcctcctctcgcctgaaatgtaccacccacggggagttgcacagcttagggcttaggcagagatgatattccatgtactttttcaggtttcccatttaaggctgtcaccaccattaagccaaatgacagtaacggaggtgcggtcacattaataacatgagggctgttctagggcaagatagggcctgcgtcatggcttcctctatccctgagaaggagggtgacagaagagaacgcctgcagggtgacagtaaaggagtgtatcagggatggggttgcagagcactgtgcagtccccactgtgggctgtcggagtcaatcaggcactcggctcattggaacttctgtcccctcagcagtaagggcggagggcaaaccttgcaaacgacacatcttagttggaggacatgattggggctggcatcatcaaccatatgagatgagcctacaacagacagcagtcagagacaataccccgggttaaaaaaggaatctaccccattatgaaatagaagaaacctcagcaagttgttgtctatgttctctgagctgataaaatggtattaccatgaactaagggtagctagtccctcaaaatccatgctaatgaaattctctaagtccagaaaaatgagcaaaaccatcattttaaaaaaatttagaaatttttatttttatttgcttataaacttcattgtgagcttttggaacaaaaaagtctgatttcctatttaatgaagaatggcttttaaacaccacaacttaatgcatagctgtatcaatattacgtaaattgacaaatgtcacacaaaatgtggtgcctaattgattttgacatgcacgtacataaagtaggaccattcaggtaaatacagagctaataattacaagaagcaaataataccaatgaaaaccattttttaagggtattagattttcattctcttcctcatcaaaaagaagcatgtattgaacatctgcctgtggctagggttgtagtaagcagaaaagtgacttgcctaaaggatgagaaatcctattacataaagattttttattttaaatgtaggcccactctccacacacccacacccatcagttacctagcagttccttataaggagtgtgaaatccaagtctggcaactcactggggacttcaagcaaaaccttctactctgtcctgttaggtgtgcagccctatgataaggcactgtggccatccgcagaataggcagaagataagcctctaatctgtacttttcaaccaatacctgggaggctttttaagagtgatactgaccttgttttcattggttttatttcattttacttaagtacttgttgccattgaaaattacagccggccttattgtcttcaattcatttgcatccccttttccaactactattcctaaagcaaatcatgcatttgcttttgtgcaagtgtctgaggactaatttctccctaaagatgcggtgttcaaatccataaattctcccccaaatacatgttgtgggttttggttcttcatatttttttatttttatttttttctgagatggtgtcctgctctgtcacccaggttggagtgcagtagcatgatctcgactcactgcaacctccacctcccgggttcaagcaattctcctgcctcagcctcccaggtagctgggattacaggcgtgcgccaccatgcccagctaatttttgtattttattagagacagggtttcaccatgttggccaggctggtctcgaacccctgaccttgtgatctgcccgcctcggcctcccaaagtgctgggattacagacgtgagccactgtgcctggccagttctcctcaatattaggaggaacattgtcaccaggctccctgtgaggtggcatttccaatgaccaaatatagttgttacttaagtcaaaactctatacctgccttgtccaatatggtaactgctagccacacgtgactaattaaaattagataaaattttaaaatctgctcttcagacacacaaaagccacatttcaaataacccatagtctcatgtggctagtagcaatgatactgaacagtgcagaaagttctgttgagaagcattgctctacattaagcttgtctaacctgccccacatgtggcccaggatggctttgaatgcagcccaacacaaattcgtaaacttgcttaaaacattatgagattttggccgggtgtggtggctcatgcctgtaatcccagcactttgggaggctgaggcgtgtggatcacctgaggttaggagttcgaaaccagcttgaccaacatggtgaaactccgtctctactaaaaatacaaaaaattagccaggcgtggtggtgcatgtctgtaatcccagctactcaggaggctgagacaggagaattgcttgaacccaggagttggaggttgcagtgagccaagctcgtgccactgcactccagcctgggcaacagagtgagactctgtctcaaaaaaaaaaaaaatatgagattttttttgtgactttttagctcatcagctatcattagtgttagtgtattttatgtgtggctgaagacaattcttccaatgtggcctagggaagtcaaaagattggacatccctgctctacatgatgcaagacgggtctgcttgtgatcttggttcatatagaatagtttctactagtatacattcaactgagaatattcaaatgagtaaaaaccacgtggactgctgcagccctccattcctctgcagaatccgggtgcaatgtaacatcaggcagtgctgtgagctgaagcctaaggacctagcacactcttgaccatatcctgaaactgttcccaaccttttcctgtgacacatttatacctcctaagtgcatacaacacacatttatgagaacacagtgaagcaaaaatgctcaagaaatggaagtgacttcagttaatttcaactcagggttgactcagtttctcctcacttttgtcaaaattttctgtgtaacatgccagtctgcattgcttctctgatagggcaggattctacagctaatgttaactaaatgaggatgttacattaattaaaactcattgttcttataatttcatgtaaaccaattaacaaatgcaaaagattttagaaaactggttttaacatttgactccaagatataaatagaagtatttcttttatttttattgtttgagacatgctctgccttccaggcttggagtgcagtggcgtgatcacggcttactgcagcctcgacctcccgagcttgagagatcctcctgcttcggggtcctgagtagctgcgactgcagatgtgcaccaccacacctgagtaatttttgtatttttcatagacacagggtctcactttgttgcccaggctggtctcagactcctgggctcaagcaatcttccccaccgccttggcctcccaaagtgctgggattataagcatgagccaccacacctggcctagattatttcttttcttctcttctcttttctttctttctttttctctttctttctttctttccttccttcctttctccttccttccttccctcctcctcctccttcttctttcttcttctctttctttctttgtctctctctctttcttttttttttgagagagtctcactctgttgcccaggctggagtgcagtggcacaatcttggctcactgcaacctccgcctcccagggtcaagccattctcttgcctcagtctcccgagtagctgggattactgggattacaggcgcgtgccatcacgcctggctaattttttgtatttttagtagagatggggtttcaccatgttggccaggctggtcttgaactcctgaactcgtgatccgcttgccttggcctcctaaagtgctgggattacaggtgtgagccaccccgcccggccgattatttcattgtttaaaacaaatactttgactttttaaaaactgaaatttgcctgtttttcccaaaagtatagtttttgtttgtttgtttgtttgttttttgagacggagtcttgctcttgcccaggctggagtgcagtggtgcgatctcagctcactgcaagctccgcctcccaggatcacgccagtctcctgcctcagcctcccaagtagctgggactacaggcgcccgctaccatgcttggctattttttttgtatttttagtagagacggggtttcaccctgttagccaggatggtctcgatctcctgactccgtgatccgcccgcctcggcctcccaaagggctgggattacaggcatgagccaccgcgcctggccaagaatagttttcaagaagcgggttaactgtgactaatcaagtacaacctaaactgacttgatctccttgagtagcctctggactttccccagagctgttatgaattcttgggaagcagctgatatattctcaaataaatacctcatttttatgtcagatcattctgatataatcttattttagaaacacagcccatagttcagtatatgacaacaatctgttcttagaatagaaatctgcaaaattaaaaaaaaaaggagcctccggaagcccagaagcatctttgaaaggtgtctctacaattttagtttcatagctctgtataacatccaaccatgcatgtaaacagctgaaaggaaaagcaacttcccttttatatgtatctgttagccattcttcctggactgtcagggaagccgatgtgggaggaggggctggcctgggatgagtatgggagaaaaagtgacttgcatattaattaacgcccatgctggccgggcgcggtggctcatgcctgtaatcccagcacttagggaggctgaggcgggtggatcacgaggtcaagagatcgagactgtgctggccaacatggtgaaaccccgtctctactaaaaatacaaagattagccgggcgttgtggcacgcgcctgtagtccccagctactcgggaggctgaggcaggagaatcgcttgaacctgggaggcagagcttgcagtgagccaagattgtgccaccgcactccagcctgggagacagagtgagactccgtctcaaaaaaataataataaaaaaataaaaaaaattaactcccatgcctcctctggcttcctttcctccatcccctgacattcatgtgcaagtggctaaaataggctaaagagaggatcaagtacagtttccgtggggaagaacatctaggtaggaaaggtaacgccatgcggtcttgaggctgggaacagacggacggcaaggctcaggctcctgtgcttgctcccctgagctggttttcaccaccagtggacagacgcctccctatccctccagctgcctccggcgcttgctgcccagaagcctccctggagccaagacctgagagcccaattctccagtggcctttttaattttaaattttgaatatttcttaggtttatatttctaaggctgcattaatgattattagtcgggtgaacttttacagtggttttaaagctaagtctgggtattctaggaaccatctaccctagcgacagcaatcctgtggtcaccaccatcagtcacactcctctggccacctggtaccatagtgatggaattgtgacatcaggtgtgtgcactttcgcatatagcttagactctcttttttttcttttttctttttgagacagggtctcactctgtcacccaagctggagggcagtggtgtgatctcacctcactgtaacctccacctcccaggctcaggtgatcctctcaccttagcttcccaagtagctgggatacaggtgtgtgccaccaagcccagctaattttttgtatttttggtggagatgaggtttcaccacgtcagccagactggggaccaatttataacattagataaatgtattggaagggcaatggagaatatttcaactgtgttagctattctaaaatatgttgagtatcacctcaaaaaaattatcattagaatacaattaattttaaaattatgagagcttttactatataatatttactgctttcctctccactacatcttcaataatttctctcttggtgcaatttttttcaacaatttattcaatcatttctctgtgtatgtacattcgagggttttcatttttggtgtctaaaactgaagctgtaataacaataaacatccttgtccttgttctggtgtgtcctttgtttagtttattaaaatttaaacagattaactgaggtaaaattgatatacaaagaactgcacgtatttagtgtgtgtaatttgatgaatttggacatacgcaaacatctatgatactatccccacaatcaaggatagatatatctagcacctcacaaagtttcctcatgtcctttttgttttgctttgttttttgtggtaaaatctaccctcttaacggattttcaagtacacaataccatagtgttaactacagacactacattgttcagcagttctctagaacttactcatcttgcatatctgaaactttcatacccactgaacagcaattccccatgttccctaccctgcagcccctggcaaccactattgtattctctgttctacgagattgactatatttatagatatctcaaataaatggagttatgcaatatttgtcctgtgactggcttatttcacttagaataatgtcctccaggttcatctgtgttgtcacaaatggcaggatttccttctctttttaagccgaacaatattccattgtacgtatatatcacattttctttatccattcctctgttgatggacaggtgggttgtttctatatcttggctattatgaataatgccgcaacaaacatgggagtgcaaatatctcttcaagatcctgttttcgcttcttttggatatatacctataaatgagattgctagatcgtgtaattctatttttcattttttgaacagctccagctgttttccataactgtggcattttacactcccaccaacagtgcacaatgcaagggctcccttttctcctccacatgatctccaacacttgtcttttgtggtttttttcataacagctatcctaacagatgtgagctgatatttcattgtagtttagatttgcatttccctgatgattagtaatattaaacaccttttcacatacctcttggccatttttgtatgtctcctttggagaaatgtctgttcaagtcctttgcccgtttttaaattgggttatttgtatttttcctattgagttgtaggaattcgttatatattttggaaattaaccgcttatcagatacacggttcacaaatatattctccccactctgtaggctgccttttcacactgctcattgtttcctttgttgatgtgtcccttttggagacaggcagtccattgtggtagtaaggaggtgaagtttagagccctattacctgagtttaaattctgccagtgtcactgttttaccttgatagatactttattctttcgcctggtttcctcatttgctaatctaggataatattaactgaatgtgacaggttcacagccactaaaattttatccaattaatgttcatcatctgttacttatcagcagattccaatttgaaccacacattggatatatatttttcacctctattctggaagctttgtggatacttaccagtaattccatatactcaccgacaaggagctttaaaaagtgcttctggacaataaaactacgacaatgtttttgagagtggtctattccctaacactacctatatacaccagtcctaaaatattttctgtgctacagaaagtaaagtgttcaaggatgtttatttgcaaagagtctgacagatatagctaagcttataaagatatatatatagatatatatagatatatatatttttagttattgagttcatcattgttagggtggtttcaaaatttgaagtttttcttatttctgtggtattttataacattaaacctagggatggcatcaaacacaatttcaaatgaatgtgttgctgtgctggatactgagaagtcagactacaaacctctgtcctcacatcaaccccagccaaccttaaattccccaagtgcaccaactaaaaagaccaagtgagcccttcatcagcacacttaccccactagcaaggacctgacagagttttcaccatatgttttgtgtttgtgcgtttgtgttttggttttggtgaaggggagaggacatgtcagtaggctcaaagctataactacagagccgactttaaatatgaaatggctttcataccttcatctcattgccagtatcaacaaccaaggacttcctggcaacacttggagattttagagacatcagtaacctttctaaaaatgattttgtgactttcattctaaatggctaggcaaacaaatcattcaatagactgcagaaaatgggccacaaaatgaccaggaggcacatgatatcatacacaataagagagtatggggacaaaattcagtttgttatgagatttaagtgcaaaattcctaactgacttaggtgcctggattaaatgtgttgggcaaatgaagagcaactgcatctccatgtgtcggaccgaaaggtccttgtataatgaccctccccaaacgaagagccactggtccaattcagtttgaggttccctacaggttatcaataaaggttttttaaaaacctgctggatcaatctggtggagggtgatttacagagtaactagaaaaagatttggcccaagatttggccacctggctgcttcccactttggccacagcgatggcttccctgctctggaatgccttccagacatttcccttcgtcttcttgctgccccttttgattctgccactcttaggacttctacatgaaaggaatacaaaaactcctacaatacttaaattcttttaaaaaggttgtttgaaagagctaacctaattaacagggaaaaaaatgcctttacttgcacttcaggacaattgtttctgctacagaagaacctttaataatcttcccaggctaaactgtggagacctttgattttatacaacccaaagcccactggaaatctgtctgcttcctccaactattgtcaaagaaggttaatttggaatttaacaaagtaaaagatttcttccaaactctcagcttgccttgggacttaagtgacgctgggtccgtttcctgcagccctgggacacttgcaagtgaggctctcagggagccttgttgactgcgttgggtgaaatgcacagggaatgcagggaatgtggcatggtgttctgtgttccttctcactctgcattgtttatgcttgctcaaataacttatatttgctcctcagttggaggttaaatttcttctgtatcatgactgaggcataaaattataaaataagtaagtataatctcctacattcctcacagcaaccatttccctacctccttccacacacaaacaacttttcagcagtgaagtggtacgtgtccttttttttttccttttaatctcaggatgatttagtctattaaggccatttaatggaatgaccagatgacaaagaagaaaaaggattgttttgagtaagagtttcctttttcatttctggctttaattgtgaggttatggctttcagaaaagaaaagaaaagaaaatgcctgtagtgataaaagagctgtatttcaacaaatgattatatttttataaatcttgtagaatttgtggatgtattttattaataaaatatttacacctcaagtttataaaggaatagacaaaatttacacagggtttgacagtcttatgtatttggtggtgaaattatcacaatttatatccactcgtacaatgctattaataaacaaaatgcttgtgacaagtatgggaattcttagaaggtaaaaattcccaggaaaacgattttaggctgaaagctaaactagggtatccctactaaaacaaggataccctaatgattattctctcctttaacaaaatttgaaagcacaccttttcctcctatattatgcagcatgtggtcataatttgtacttgttgctgtgttgaactcacaatagaaaaaataaatgaaacatcttttgagtaaactaaacagatgtctcatgttatccttttaaaatacagctggagaaaccttagagatcatcttgttcaacggttctcaacagatgctccctggaccatctgtatcaggaccatcttgggggtatattgaatgtgcaggctgtcagccccacaccaggcccagtgaatcttagagggtagagcccagacatctacagtgttaccaagcaccttatttcattcttccatacactaaattttgagaatctctgttgtcctatcttttccattttcaacaaagaaactcttacccaggttgtccaagatagagtagcagaggtaggcagaacttcatccaatagtaaaaataccacactgctcttctgtaatataacatttactaaaaactaaactatagaaaagcagaattaatatttctattaaagttctgcaacgtacagcaatattttaggcctttcttatccattcttttattccacaaaccttcattgaatgcctgcactacctaaggcatcgatgctgtagcagtttaagtttacaactgagcggagatgagacattacacaaagaggtacagttcaaggaaggctgccacaaacaccacaggagcaggttaactaaagggatcaaaaagttctaagcagctagccctcacctctggttcagatgacccagatgacttcacagaggaggggctgttctggccatggctgagctagcaacagatatggatggacaagggataaactcaccttactattctcgttccctagcaagtgtaaacattaaaggcttctgtcatcctggggctgcagccttcaaaggaagttctttatacaaactaaaaattagaggtgaaagaaaacaggatcctcattttaggtatggaatctctaaccctgcttttccctgactcccagcctcaaatactcctccttttcgggttctgttgtagatctcgatcctgtcctcctcccgcaacttatgatagggaatcctaacactcaccattgataatacattatccttttaggaggatatcctttgaggggactggcaatctccctggggtcagaaaatgagtacgtgtcagctaccagggtcatgcagccaccctgagcccaagccagtgttcctaccactgcagagttccctggcaagggaacacatggagatagtatctgggagaggaaagggaatccagagcagacttctgaaggctgtggggagggactgcaggctgcgaggctttgctcctcgctccttttcctcttcctactcctttagcagtaagagctccccaaccatgcttgggctatggccatgccatgtggcagtacagttagcagacaactgccctgctaagctttaaaaaacaaagacactaaaacctgataaacaaccagcttttctttgcttccttggatcagtaaattttaaaaagaagcaggggaaagaaaacagagaactgacctagaattgccaaccttttatttgggcatctaagaacatctgaaaaataagcaaaatagaaaagcctctatttcagtaaagagcaatcctttaagtagagtaaattcagactataaaaacaaacatatgatgttttatctgttttgtaaaaatcatttttccttggactagtaaaaactgcatcatgtcgccccatctgtagtacttagaaacagctgcaggctgtttaagtttctgtaagtttctataagcatagctcagagactcaaaagagaagggggaagaaggcttgggacaggaaaggaaagagcaaaagcattagggtttttcaagacgtaccaacaagcataaagttccactcgacaatttcagattttaaaacccctcatcatctataatccaggctatgcctgttctttgagccaacagaaccaaactggatgagatgccaatttaaaaatactgtgtgctctaaataaacttaaacatcagcagtgtagaaaaaccacattatatcaaaacatattgtttaaggtactaagaaatgtctctgcaaaacttaatatgagctttaaaagcatatcatgccaccatcaccatcagtcattaaatttttattttttcatttaagcttttattatttaaaaaattttcagattcaggccaatgttaaaagatatgaggcagaaaacaaaacctaaatattaaaaaggaagataataaaatatgtatttttggatggtgtgtttataggaatcaaatggtaaacaattacatttaatttacagctgagggtccctgtagtcacagttacttgggaggctgaggcaggaggattctttcagcccaggattttgaggctgcagtgagctatgactgtgcctgtgactggctgctgcactccagcctgagccatagagagaggccatgtcttaaaaaaaaaagtaggtcaatactagatatacaaaaccaaattaccagatactaccagtttgaaagtatagtaaaaaaagatcaaaacacaaactataaaataagtaataacataacaataaccataatgagaaatatgtaggacctatttagagaaaattggaaaattttgtgagaaatataaaaagtaagatttggataaatgcttagtacatgtcatgggctcggtggtaaagactaaaacctgttagataaacagtttttccccaaataatctgtaagttcaacataaattttccaaagttcatctgaaaaaacaaacaggaaagaacaacaaagaaaattttgcagaagagtcctgcagggggactggccctatcagatgccacaacatgtaagccgtgtggcacagacagaaggacaggcaagcagaacaatggaacagagaagataacccagaagaaacacccatccatattcagaagatgccacaaatccatcaaataaaattgagaaaagatggcacccactaggtaacaattcagaccaaaaacaagagcccctcacctgattctatatggtgaaatatattccacatgaatttagagtttagcaacaaaaattttgttaaggtagaaaaatatattgtatatatataatataaatatatacatatataatataaatatatacatatatatgtatatatattttttgagacggagttttgcttttgttgcccaagctggagtgcaatgcgcaatctcggctcactgcaacctcctctcccaggttcaagtgattctcctgcctcagcctcccgaatagctgggattacaggcacgtgccaccaagcttgactaattttttgtattttaaatagaaatgaggtttcaccacgttagccaggctggtcttgaactcctgacctcagatgatccgcccacctcggcctcccaaagtgctgggattacaggcatgagccaccgcacctggcctatatcagatattttaaatcacttctaggaaaaaaaatgactttctaagctaaaaaataatagaagaatctaaaaagaacagagtaacatattttatcatctacaaatcttaaacttctatttttattttttaaatacacttaaatgcaaacaccaaattggaaaaagtatttgtagcaaaggtcatcatcaaaagactaatcgctttccaataaacagtgctataacatttgtataagatttttggtagcccagtaagctaagacaagctttggggaaggcaatttggcaatacatgtaactggagccttaaatatatttgtatctgtgacccagtaattccacttctgggaatctagcctaaggaaacaatccacatataataaatattctctgtgtacaaagatgctcttcacagggaaaaaaactgaaacgatctaaaagtatattaaagaacagttaagtaaatgatttaaaaattttaaatggtacttagagtgtataatagtatttcaaagtgtttataataaaatgttaaagaaaaaatcaagatactaaattgcatattcaataaaaatacaattttattttttaaatatagatttatatatgaaagtattaaaatatttatttaaacactattatatccattttatatgtgtatgtacatatatatgtgcatatgtcatatgtttacacatatgtagaaatatattaggtataacagaaatatatgcaataggaatatacacacacacatatatacacgcacacacaaatcacctgcttaatgcctttaatctattcaaaaaagaaggcattgaggctaagacatcaatgtattattaccatttgtttcaaagtgtaatataattaattctcagatcatcctaaagttccaattttttccaaccaaaataaagtcataaaagaaacacttggttaatgaattaaacgtatattaaagagtccttctcatatttaaagctatgaggcatttaaatacaaataaaatcatttagtttcctaaaatggtgagcaacacaaaaacattctggataaaagttctttattgtttctacttccagcagcgtacatcctgaacctacattctctccctagataaggagtggctctggctcagtgtccccagagttccagcagctctcatgcattttcacccctgctattagaatgaccccagtgtgtagccgcacacactgactgcagcacagaggaatgcgggatggcatcagcagtgctaaagagtggggctaaaagcccagcgagaatcacaggagaatgcagaactgtgttctgaggcagcagggatggactggatctaatctagtgctataagtgcaaaatgcccaggaaatgtgctctgtggatagccaaggactcctgctccccaagacagagacgcaaatctgctcccttagttgggtaaacaactctgggaagataaataagtgagcaggcctccaagtaaatcaacccacagcatgtgtgcataacgttttagtgttaaatacaaaataatctttgactgattgtcatttcaagtgtttataatattccaggggtcctgtcataatgttcttatcatctgtaagctgaaagacatatcagaaatttattaagtttgtaaataaaactgctatgtttgagatcacttgattagtgcaaagtttaatctattttgtatgaaatactttttttctctgttaagatggtaagtttgcttctcagacattttaaatacttaaaatatatgaaacctacaaatgtagttttaaatgtctgagggaaatctaattagctaaaattaatcaacaatcagtcttattttatgcaaaaataattagattcattaatagaataacaagtcttataaattgaaaaggaaaagaaaaactagctttaaaaaagtctaacttcagtaaactgaatgctacttttgaacaccagtaactacaacagttcttttggacattacaaactagcattaactcaccccaacctctccagcagccaggctgcagagatgtaagctaggctccacggagcaggcacacccatgggaaactttgatatgaatgtcatggcagtccctagcctctcctcagtcctctcccacttttagctggcactgagtaatccattccttcctccagaagagacccagtgctgtgagacattattcagtcaaagtggttttacaaaagtcatttagtaaatggcttactaaactacttagtaaacgactaagtctttggtaaacgacttcactaaactgctaaccacaggaaaatggttagtagaattaatatctttcccacataccacatagcaaaacaattttaatttcttccattatttgtgtcctttcctctgctcaaaagttgcctttcccgccagcttcactgtctctcttttctcctcttccacccctctcttcagattcagatctggctgtcaatggcatgccccgatcagcaaaacaaaagttccaccatgggccagagagtggccatccaccccgaccttgagtccacctcgccaaatgtgaaagcccaacgaaactgggaggggacggggtgggatcccgctgccaaggaaatgagatttttctcctgtcatttaaaatgaactgattgttatacataatttgaagcgaaataagagataacaggaaacaggccacctgaaggaaacagaagcagagccacttcactattttgcttaactcttcatgccaccagtaaggatctttaaactggaaaaggctggagcccaggaagagcatttcaacaacttcaaggcgcagtgaattactcccactgcaatgaaaagcaattacatatgtttctgtgcagccattgttggtgtagtttcctaagggaaaaaatggacagctgtcaggaaatggaagccagaggaatgtttctcggttttctgaaaagagcaaagagtaatgttctggtaaatatggcctggaatcctaatgaaatcctaggacagactgttagatgaatgttcggttgtgaaaggaatagagtccgctcaataaaaaatatgttgaaaaatgattaggctatcctctagtccttcacagaggacttggtgagacagtacatctctatcaaactgctaatgggggaaaggtaatcttatttcactacatctacatctactgttaaaaaaaaaaaaatagaatcatcagaaaatcaatgccagagagtgaaagctataaataagagactctgccagcgagatgtctacttgttccagtgcagcccggtgaagcctgcatagagagcttgcatcagtgcatgctctctaaaaaggtatgagggaggcaagggcactggcaccaggccaagctctacctccctgccaggtaccttggtgcagggcccacattctcctagagcagcatcttttccaaagatactttttgtggccctatgaacaactgaatgaagtcaggagctggaagctcaaatcccccttcttccatgcaatactctgaaaccctccctgggctgcagtcccttatgaatggatgtgaggtggccttccagattgacggtgaggactaaatgtcaacaggtagtaggagcatcaaatgcagtgcctggtgccatcataggaaaatccccaaggggaacagagctctgaagtcctcctactctccaattctgagattctgtgaccagagtttgaaatcggaaacttgactcagatcctttttggtcatcttttctttgcagtaaaaatgtaaaatgtgaactgaaaaaaggggattccctgaatggtagtttgtctttctattcttcccatcttgtagagttcaggcaaccctcatcttattgtgcttcaccttattgcactttgcagatattgacttttttataaattgaaggtttgtggcaactctgttcagcatgtctactggcaccattcttccaacagcatgtgctccctttgtgattccatgtcaccttttggtcattctcacaatatttcaaactttttcatcgttcttatatctgttgtggtgatctgtgatcagcaacatttgatgttaccactgtaattgttttggggcaccacaaaccctgcccatataagatggcagccttaatctacaaatgttgggtgtgttctgactgttccactgaccggccattcccccatctcttcccctctctgcaggcctccttattccctgagatacaacattattgaaattaggccaattgataaccctgtaagggtttaagtaaaaggttcaaatgttcaagtaaaaggtctaagggttcaagtaaaaggtccgtcatattaaatcaaaaactagaaatgattaaacttagaggaagccatgtcaaaagatgaaatacgctgaaagctaggcatcttatgccaaacagttaagctatgaatgcaaaggaaaagttctgaaaggaaatcagaagtgctactccagtgaacacatgaatgataagaatgcaaaacagccttattgctgatatggagaaagttttagtggtctggatagaagatcaaaccagccacaacattcccttaaatcaaagcctgacccaaaacaaggccctaactctcttcaattctgtgaaggctaagagatttgaggaagctgcagatgaaaagtttgaagctaggagaggttggttcatgaggtttaaggaaagaagccatctccgtaacataaaagtgcaaggtgaggaagcaagtgctgatgcagaagctgcagcaagttatccagaagatctggtatgataattgataaaggtggctacaccaaacaacagactttcgatgtagatgaaacagccttctattggaggatgatgccatctaggactttcatagctagaatggaaaagtcaagtcctggcttcaaagcttcaaaggacaggctgtcttgttaggtgctaatgcagctggtgactttaagttgaagccaatgcttatttgtcattctgaaaatcctagggcccttaagaatgatgctaaatctactctgcctataccctataaaaggaacaacaaagtcgggatagcagcactctgtttacagcatggttggttgaatattttaagcccactgttgaggcctactgctcagaaaaagattcctttcaaaatattactgctcattggcaatgcacctggtaatccaagagctctgatggaaatgtacaaggagattaatgttgttttcatgactgctaacataatatccatgtgcagcccagcccatagattaaggagtaatttcaatttttgagtcttaatatctaaaaaatacattttatgaggctatagctgccatacatagtgatttctctgatggatctgagcaaagtaaattaaaaatcttctggaaaggatttgccattttagatgccattaagaatattactgattcatgggaggggttcaaaatatctacattgttgattgattccaaccctcatagatgactttgaggggttcaatagttcagtggaggaagtaactgcagatgtggggggaaatatcaagagaactagaattagaagtggagcctgaagatgtgactgaattgctgcaatctcatgataaaacttgaacagtcaagaagctgcttcacgtagatgagcaaagacaatggtttctcgagatagaatctactcctggtaagacaccatgaacactgttgaaatgacaaaaaaggatttagaatactcataaacttagctgataaagcagtgacagggtttgagaggactggctccagttttgaaagaagtcctaccgtagatcaaatgttatcaaacagcatcccatgcttcagaaaaatctttcatgaaagagagtccatccacgtggccaatttcactgttgtcttcttttaacaaattgtcacagcacctcaaccttcagcaagcaccaccctgatcagccagcagccaacaacctcgagtcaagaccttccacaagcaacaggattatgacttgctaaaggttcagataatcactagcatttttaacaatgaaacattttaaaattaaggtatatatattgtttttcagacacaattaataaactatagtatagtgcaaacatattttatatgcactgggaaaccaaaatattagtatgactgactgcattgtgatatttgctttattgtggtggtctggaatctaacccacaacacccccaagatatccctataaacgataaaaaaacaaaacttctgaagtaataggtttatacttgttcccctgtgaaataaggtgctgaagagtcacaaaatcatgctctttgctgccctgtgttttttcctttgtgttttgatcagatactaggaagcaacatttatctaacaggtagatttttacacaaaaggttgggaaattccatctgaccaggtctagtttttactggtgatttcattaagtgtgtggggggccagatggatagaaatgaagtcacttaagggatacatattgaaggatgtgcactacctacatatctgagattttaaaatatgcaaaattggccaggcgtggtggctcacgcctgtaatcccagcaccttggaaagctgaggtgggcagatcacttgaggtcaggaatttgagaccagcctggccaacacagggaagccctgtctctactaaaaatacaaaaattggctggatgtggtggcacattcctgtagtctcagctacctgggagacggaggcaggagaatcacttgaatcctagaggcggaagttgcagtgagccaacatcacgccactgcactccagcctgggtgacagagcaagattctgtctcaaaaaatatatatgcaaaattgaaaaaagcatacacataaaggaatatgaacataggtgtcttggcctgttgtgcggctataacaaaatcccataggctgggtaggctctgggcagccaaaccccatggctttgctgagcacagcccagagcacacctattgcgagctgtagtcaggtgcctgcagctctcccaggctggaatcgcacaccagtggctctactggtctggagtcatgtggtggtccaccctcacagcagcctctgcttggctcacttgaccaaggcttctagctgctacattcttcagaatctaggtgggtgtatcaacacccctacagcttgtgcactctgcatacctgcaaagatggcactgcctgggggctgacaaggtttactgactctgtctcctggaggggcagccactgccacacctgggcctactaaagccaaacctggggtagctgaggatccctgccctagaatgtggagagcagagctttgagatggtgcccagttgtgcagcaagcacaggggtcccacagttcatccttggcccatcctttcaaattgttctgccaccaaggcccttgcattctggccttgtgatgacagtggtagccccaataatctcgaaaacgtcttcaaagtcattcttccatgtcttcatgactagcacctggtggattcacaccaatctcatcaaagagttgcttggccacacccttgctgttctctcccaaacacacttccacagtatggacaggtttagaattgtccaaatatttaagttcttcttccctcttgattgaaaattctgcttttaaatcattattctcttctcacattttactataagcactcaacagacgccaacccacatctttgacactttgcttagaaatttcttgtgccaaatatcctatttcattgctcataagttctaccttccacaaaatgtgaggacccaaacacaacttagttaagttctttgccactttataacaatgatcatgtttcctatggtttctaataacatgttcctcatttccgagacctcatcagaattgcctttacagtccatatttctgacaatattctgatcacaaccacttaagcattccgtaagaagatggaggctttctctacagctctccttccctccttctaagctctcaccagaattgccctttagggtccattcacagcaatctaagctttttctagcatgcacctcaaaactcttcttgtctctatccattatccagttccaaagccacctccacatttctaggcatttgttataacaacaaccacactcccagtaccagtttctgtctttgttcattcaggctgccataacaaaataccatagacaaagtagcttataaacaacagttatttatttctctggaggctgagaagtccaaattcaaggtgtcagtagacccagtgtctggggagagcccactctctcttatatagtgccgccttcttctgtcctcacgtgatgtaaggaggcagggcagctctctggggcctcttctacaagttcactaatctcatttgttacggctccactcatgacctaatcacctccaaaaaggccccatctcctaacaccatcagtttaggggttaatatttcagcatatgaattttgagggagcacaaatgatatggtttggctgtgttctcacccgattctcatcttgaattgtaactcccacagttcccatgtgtcataggaggaaccccagtgggaggtgattgaatgatgggggcggatctttcctgtgctgttctcctgatagtgagtgagtctcatgagatctgatggttttaaaaaggggagtttcccttcacaagctctctcctcttgtcttgctaccatgtgacatgtgcctttcaccttcctccatgattgtgaggcctccccagccacatggaactgtcagtccaataaacctctttcttctctaaattgcccagtcttggatatgtctttttcagcaacatgaaaatggacgaatacagtaaatttgtatcaggagtggagtgctgctgaaaagatacccgaaaatgtggaagcaactttggaactgggttaacaggcagaagctggaacagtttggagggctcagaagaagacaagaaaatgggagaaagtttggaacttcctagagacttgttgaatggttttgacaaaaaatgctgatagtgatctgaacaataaggtccaggctgaagtggtctcagatggagatgaggaacttgttgggaactggagcaaaggtgactcttaccatgttttagcaaagagactggcagccttttgctcctgccctagagatttgtggaactctgaacttgagagagctgatttagggtatctggcagaagaaattcctaagcagcaaagcattcaagaagtgacttgggtgctgttaaaggcattcagttttataagggaagcagagcataaaatttcagaaaatttgcagcctgacaatgcaatagaaaaaaaaatcccattttctaagaagaaattcaagccagctgcagaaatttgcttaggaatgaggagccaaatgttaattcccaagacaatggggaaaatgtctccagggcatgtcagaggtcttcacagcagtgccccctccctgcccatcacaggctcagaggcctaggaggaaaacatggttttgtgggccaggcccagggtccccatactgtgtgcattctagggacttagtgccctgcatcccagtcgtgactaaaagggcctaaggtacggttcaggccgtggcttcagagggtgtaagccccatgccttggcagcttcgatgtggtgttgagcctgcaggcgcacagaagtcaagaactgaggtttgggaacctctgcctagatttcagaggatatatggaaatgcctggatgtccaggcagaagtttgctgtagaggtggggctttctttcattgagaacctgtgctagggcagtgtggaagggaaatgtgaggtcagagtccccacacagattccctactggggcactgcctagtggagctgtgagaagaggaccactgtcctccagaccccagaatggtagatccaccaacagcgtgcaccatgtgcctggaaaagccgcaaacacctgaataccagtccgtaaaagcagctgggagggaggtggtaccctgaaaagccacagggacagagctgcccaagaccatgggaatccacctcttgcatcagtgtgacctggatgtgagacatggagtcaaaggagaacattttggagctttaagatttgactgccctgctggattttggactcacatggggcctgtagcccctttgttttggccaatttctaccatttgtaacagctgtatttacccgatgctgctacccacattgtatttaggaagtaactaacttgcttttgattttacaggctgataggcagaagagtcttgctttgtctcagatgagacattggactatggacttttgagttaatgctgaaatgagttaagactttgggggactgtcaaaaggcatgattggttttgaaatgtaaggacatgagatttgagaggggccaggagcggaatgatatggtttggctgtgttcccacccaaatcttatctcgaattctaactcccacagttcctacgtgttgtgggaggaacccagtgggaggtgattgaatgatgggggtgggtctttcctgtgctgttcttgtgatagtgaatgagtctcacaagaactgatggttttaaaaatgggggttttccttcacaagctctcttctcttgtctgccgccatgtgagacattcctttcactttccatcatgattgtgaggcctccccagccacgtggaactgtaagtccaataaacctctttctttcctaaattgcccagtcttggatatgtctttatctgcagcgtgaaaatgaacgaatacaacaaacattcaaatcatggcaatagaaaacatttatataggatccctcagattttttttgaaagcaacaacttatttaattttcatcaatagttatatttagtgatcatatttcagaatgtttcatataaaatctattagacaaatgaacacaacatggttattacataatgctaatacaggtggagcacccccagtctgaaatctgaaatgcttcaaaatttgaaactttctgagtgccaacatgatgttcaaaggatgttcatcagagcattttggatttcagattttcagattacggatgctctacctgttaggtatctgcaaatattcaaaaatctgaaaaatatctaaaattcaacatactttttcacaagcaatttggacaaggcataatattgaagaattactcccaccttgaattctctttggagtgaggaaacaataaaatgcttattaaatatatggaaatacataggttatagataacagagaaactaaaatgtattgatttttggttcattttgattccgtttcagctaatatggatggttgaaatgaagtataaacagatgaaataagaacaaagataaggagtgttagggtgggtccctaggaagggaatgtggaacattactgggatgataataattatccaattaggttaatctctattattttgtacattcaatcagtagccctgaaaagataaagccaatgtttcatgaggcagaaagtgacttctaaggaaagaagcccccacaaagccatgatcctcccaactgttaggtaaaagtggacccccactagcatgaagaaataatcgtctcttctgtttttaattatatatggacagacaagttccaaatccttattttatgttttctacttcaattattcctttcctattgcaatttgagttcattttctattctgctctcaattaagtgaagtcaccattttccctttaatcatatgttatcctccaatttactttcctacttcatttacttccttactattgtctttgggaagttttatcagctcttcagatgggcagaagatgtggtggcagggaaaggggcaggggctggctggagaccacctgacagggagtcaaggcctgtctcaccaggtgtgtgagcacaggcaactgtggagccctctgaaccccaacctcatcttcagtaaaatggaacagccacatctacatcactacaggtttgcttgaagtttaaagctattctacattaggagttcaataatcataataaagttgtcagttttctttttacctcctaatcaatgtgttagtccctgaagaaaatcattaagtaaaaaggaccccaccgacccactcacccacacactaacacaaaatagttgtccaatggcaggaagttggattaactgattaatttattcaggaaatatttatttacattttgatctactccatgccagatactgttataggtactgaggatacagcagtgagcaggcaaaagctcctgctctcgtggagcttctattccagtagggaaaacacaactaataaaatgaatgagcaaaatgtatagtatattaaacggtggttaagtgccattagagaaagagaaggaggaaactcagggtggggggatggcaaatgtgatcttacagggggttcaggcaaaggtgacatggaaatgagactggaagtagtgagtgaggagctgcatggctgtccagaagcaaggagccacctgaaaaggctctggggcaggagtgtgctgggcacgtgaacacagccagggtggctggaaagagctacaggggaaagagaaggaggagatggtgagaagggagaggtacaggccttcctttggctttgactgagtgagatgaaagggcaagccaagttctgagcagagaaataacatagtgcagcttacctttaacaggatccttctggttctctgaggggtgcagtgggaacaggctgcaacagggcaagtgtcacagcagaagctactaggaggctacttcaacagtacaggtgagagatgataagagtttaggtgagggtggtaagcagtcacatactggatctattccaaaagtgcagcctctgcagagtttgctgagggactggatacatgcagagctgagagaaaaaagtcaaggatgaccccaaggtttctggcctcaacaagttactagctgtataaactgcatacaaacttgtttctgaccccgaggactagatgagtaatcaatatacatgaaggcacagcccagtgtacggcacatgggcttgtgtggtatgcttaggttcaagtttacaaactctattgaatttctactttgtgctttgccctgactttgctaggtccagaaatacaaacatgagtaagtgtgaaatccaccctcaggagtttatgatctagtgagacaaagaatcatcctttatagtacaagcttccccagcagccacagaaatgagtagaagattcagatgtcagcagggaagggaatgattgactcagagggaggatatctaggagggctgcctggagtaggtgacaacagagtagtggtgtcttctcaagaggaaaatcgatgaggactggcacagctgggaaaaaggtgataaagaggacagtagtggctagacttctcaagaagaaaatcgatgagaatggcacagctgggaaaaaggtgatagagaagggcattgacggaacgcttacccgctactgaatgatgatcacttattgttgaagatagagactgtgtctcttctaacaccacaatcctgagatgtaggcacgacatcctgaagatcgcaatgtgtacacagtttcttgtaaatattctgcaactacatagttatttgtttgactgttcctgctttcacaattataatttggtccagtcaactctagtcagcaatataacattaccttgtacacctccaaagcaaaattgtgcaaaagtatagctgcctgaggaggcaagtcctgatccccactccttggggccttctctatccatagatccaaaaaaccacagatgcttctggtgtgttctgccaatgatccttggcagtaaacaagtgtcacgtctgactaggcaccatggctcacacctgtaatcccaacactttgtgaggccaaggcgggtggatcacctgaggtcaggagttcaagaccagcctggccaacatggtgaaaccccatctctactaaaaatacaaaaattagccagcttggtggcgggcgcctgtaatcccagctactcaggaggctgaggcaggagaatcgcttgaacctgggaggtgaaggatgcagtgagccaagattgcaccactgcattccagcctgggcaacagagcgagactctatctcaaaaaaaaaaaaaaaaagtgtcacttttaataacattactcaattgatgacatgtctgcatcatcatcaattatgattcaggtattttcatactgttctcatatactttgtaccagcccgtaattctgcatttgcttttattttcttagtaagatgaaataaaaggactacaaacatttagaataatatgaaaaaagaagccacaaatattaaccctctagttcatgtcatcaaccctgaatgcaactctatttccacaaattggaagaggggaaaaaatccagatagtaaatgaaatttttactatcatattttattctttaatttgaatcatgaagaactttgaaagtttattttgtgagaaaactggaaaattaaaaactaacagaaatagttcataaagaaatgcactttttaaaactttccactgcattctcttcctcttggtggtgaaagtatagattcaactgcttggaaaaaatatagactacgcgcccagtatcattagtttgaagtttgttctaactgtggtatagatagaggaagaaatcattagcaaactaaaggtaaaatacactcaactatatgaaaatcaatcaacagtcaggcttcattttttaaaaaaactttccattaaatcacaacacgcactcaagtttacaagggtcaagtcctagtaaaaacacctttaaaaatgaacaagaaaatcagagctattcttcattgatgttccttttttgtcatgaacctgttctgtatgaacaaaattcctttatttaataaattgcactaaggcatcatttgctcagccataatggaattactttgatccaacggaaataaataaggactagagaagtggaaatcaacaagtcagcaagttaacatctcagttgttgtatgctattcacctctaaagaaaaaaacactaaaggcccgacacggtggctcatgcctgtagtcccagcactttgggagaccacggcgggtggatcacgaggtcaacagatcgagaccatcctggccaacacggtgaaaccctgtctctactaaaaatagaaaaattagccaggcgtggcggcgggcgcctgtaatcccagctactcgggaagctgaggcaggagaatcgcttgaacctggaaggcggaaattgtcaatcccatttaagaaaactatcttttctatctaatatgccaggttttgacctaagtgattacaggcaagcccagcctctataaacaaaatgaggctgttcccacaaaacacactagaagggggcccttgccaggctccctgtctcacccacttccctccccatacatacacttggcggcttctggcttggagaagggtgagccaggaggaagcaaaactttccaactgatctatgtgtcatcgtttttaagctccatatgaagctcaagatgaatattttataaaggcacaaaccctgcatgccacaaaattttagttttcttacatgatcaactgtacttataatatcatgtaatatttatctagaaggatcttcttgtcacttggtaaaacagtgggtaaaaattaaagcccaatgcactgagaaactattaaatgaacaaattacatgttcaatcttaccgagtttcagaatctttttttttttgagatggagtctcgctctgtcgcccaggctggagtgcagtggagtgatctcggctcactgcaacctctgcctcccgggttcacgccattctcctgcctcagcctcccaagtagctgggactacaggcacccgccaccacgcccggctaattttttgtatttttagtagagacggggtttcgctgtgttagccaggatggtctcaatctcccgaccttgtgatccgcccgcctcggcctcccaaagtgctgggattacaggcgtgagctaccacgcccggcccaagttgcagaatcttaacaaattaggaaattagatatttgtcctctttttctgaaatcaggggaacttcggggaaaaagcagcaatctaagtagaccacagcaacaagaaattcctttatggaaaatttgcttgtaaaaatccaaataaagacgtatttgtagagggcaacctgaaggcaaaatatcatgctcatacaaaatgaactgcagaattgagaagcacaagtgcctggaggcagccccattatcaattctttgacctcttggagctgggtgtgagggctaaaaataaacttacttcaccagctgaactccttcaggccttaacatctaaaatcctggatccatagatgtgtttggataaaggacggagaccaggggtgggcaaagtggtagcaaaagggtggcgggtgctgcaggccacaatgagggttcaggatttccttctaaatgtgattagcaggagagtgacaggatgatttacatctgaaaaggactgctccaactgctctgcggagatgagaccaggtggatacagagaaaccaggtactggctactgcataatccttgtgagagacaaaggtggctcggatcaccaagcagtagagcaggcagtgagaagttatcaaatttggcatgcagctagaggagaaagccaacaggacttgatggtcagtcagatctggattgcagaggaagagaaagtcaaatctcttccacttttcacaaaaataaactacagattgttccagtagtcaagatacatcattcaaaggaaaactatggcaatggctataaacaaataatttaccaaaaaaaaaaaagatgtatgtgcaaatcaccacatcaaaagatttcaacaccactagtaattacagaaatgcaaactaaagcaaaaactagaatgctttcccctgtcttattagaaaaaaaaataaagataatcgaagtgggctgaacagtattcctcaaaattcatgtctatctggaacctcagaatgtgagagtctttgcagatgtaattagttaagatggggtcagatgggattacagtagaccctaagcacaatgactggtgtccctataagaagaggagaggacagacagagatacacaggcagggaagaaagccaggtgaagatggaggtagagactgcagcgatgcagctacaagccaagaaacaccaataggaactgcagccgccagaaactaggaagaggcaaggacagatcctcccctggaacctttagaggaagcatggccctgctacaccttgagtcagatttttggcctccagaactgtgaaaggatacatttttgttgttttaagccaccaagtttgtggttctttgtcacagcagtcctagcaaactgacaacgtaattgacagtattactgagagtgtgaaaagtacagtcatcctcaggcctgttggcaaaagcatagattagcacaacagcctttgggaaaaataatttggcaatgcttgccacaattgcaaatgaccagatcttttgactcagcaattccaatgtgaggagtttattctaaggagataattagaaacatgtgcaaagattttaaaagaatgttcctcacagggttaaaactggaaaaaaatctaaatgttcaaaaatttaaaataagtcaaaaaaactatggcgcaaacttacaacaaagtaccatgatgggaagatagtttggcagtttcttacaaaaccaaacaatcttaccaacccatccagccatcacactctttagtatttatccaaatgagtcgaaaacatatgttcacacaaaaatctgcatatgaatgtttatagcagctttaatcataattgccaaaacctgggagtaaccaagatgtcctcaaacaggtgaatgaataaacaaactgtggtacatttatttaccgcagtttagaatattatttagcaatacaaagaaatgagctattacctacaaaaaacatggaggaaaattaaatacgtatttggtttcttttacttagtaatctgaaaaggctggatattgtatgattccaactatctgacattctggaaaagcaaaaactgtgactgtgaagattagtggttgccatgggtttccaggggtggtatgtggaacaggtggagcacagagggtttctagggcagtgaaactactttatatgatactataatggtggatataagtcattatacatttgtccaaatccatagattgcagaatgccaagagtgaacccaaatgtaaaccatgaactttgcatgataatgatgtgtcaatgtaggttaatcagtggtaactaaagtaccgctctggtgtggatattaatagtgagggaggctatgcctacgtgggtgcaaggggtatacagaaactctctgtactttccactcaagtttgctgtgaacctaaaactgctcttaaaaataaagttaggccgggcgcggtggctcacgcctataatcccagcactttgggaggccgaggtgggtggatcacttgaggtcaggagtttgagaccagcttggccaatatggtgaaacctcatctctaccaaaaatttaaaaattagccgggtgtcatgatgcacgcctgtaatcccagctactcaggaggctgaggcaggagaattgcttgaacccaggaagcggaggttgagccgagatcgcaccattgcactccagcctgggcgatagagcgagactccgtctcaaaataaataaataaataaataaataaataaataaataaataaagtttaataatctaaaataaaaattaaaaaatgttcttgaaaaatactgggtttttttgttgttgttttgtttttgtttttgtttttgagacagagtctcactctgtcacccaggctggagtgcagtggtgcaatctcagctcactccaacctccgcctcctgggttcaagcgattttcgtgcctcagcctcccaagtagctgggaccacaggtgtgtatcaccacacccaactaatttttgtatttttagtagcgatggggtttcaccatgttagccaggctagtctcgaactcctgacctcaagtgatctgcccttctcagtctcccaaagtgctgggattacaggcatgagccactgtgcctggccttgaaaaagtatttgatgataaggttattcaagacatgtgatgtactattaactggaaaaagcagaatataaaaatataaactacagtatgattctaattttgtttttaaaaagtatatggtagcaaaatattatctaacaattggtgaatctggatgaaaaggtacataggagttcattatattattcttgctacttgtgtgtaggtttgaaactttttcaaaataaaaagtaaaagaattgaaaaaggccaggtacggtggctcatgcctgtaatcccagcactttgggaggtcggggcaggcagatcatgaggtcaggagatcgagaccatcctggctaacacagtgaaaccccatctccactaaaaatacaaaaacttagccaggggtggtggcgggcgcctgtagccccagctactcgggaagctgaggcaggagaatggagtgaacctgggaggtggagcttgtagtgagccgagatcgcaccactgcactccagcctgggtgacagagcgagactccatctcaaaaaaacaaaaaagaattgaaaagaagtggtacatacatgtattcatatgccattagacaaggcatagaaaacactacactattaatactggttatctctgagcgatgagattatgcacaatttcggaggtttgtgtgatttcttatattcgccaacatttctacaataaacatgtttgtaatcaggaacatagagttaatgtcatttaaaagcaataacaaatgcaagggtctaagaaacctaagaacattaatttgaaaaataacaaacctcttcaactaagctatcaatgccacctgctttgttgttttaacttacccatcacattcatgttcatggcctttgtaacctcttccattcctcccagcttcccccaggttcccgcgacctctttttcttttgcctggcaacctgtctccctatgcagagatgttgaacaccgcctaattcctttgcttgcataacaaagttcctcagaattttcaaccacaagttcttccattcctcttatcattttctgctctttagaaaaacaaagtgagaacaacagtgctcttggaaactaaaaatatggacagagaggggaaaaacaccgatagaaatttggaagataaagttgagaaattaccttataaagcaaaaaaaaaaaaaaaaaaaaaaaaaaaaaaaaaaaaagaagaagaagaaggaaagataaagagggaggagacaggagataaaaggtccaacatgagaagaagaaaatgtttcccaaatttcgaaggacattttctattttgaaagggcctactcagcaagtacccatcacaacgaatttaaaaagacctattccatggacatcagaacaccagggataaagagaagagcctaaaagcttccaaagagacagaagacttgagaaagtgtaaaggactgggatatcagaatagcactggatttagtgataacactgggaactagaaacaattaatgatgcctacaaaattagaagaacaaatttccaacctagaatgctatactcaaccaagctatcaagtgggcaggtgatataaagacattctcagtcattgtacctcccttgacactacagtagccaccactgatgtccacccctgcagccaccctcattcttccttgctaacaaattcaaattttattctgatattaagtggccatctgttttgaaggtggggcaccagtcccaagagggtgaatttattagcagacgccagttatggcaattccaatccctttgatacgacctgagatgtgaagttggctaggaggttttgagaaaataatctcctggcttttaaaaagaggctcggccgggcacagcagctcatgcctgtaatcccagcactctgggaggccaaggtgggcagaacacctgaggtcaggaattcaagaccagcctggccaacatggtgaaaccccatccctactaaatatagaaaaattaggccgggcgcggtggctcacgcctgtagtcccagcactttgggaggccaaggcgggcggatcacgagatcaggagatcgagaacatcccggctaacacggtgaaaccccgtctctaccaaaaatacaaaaaaaaattatccgggtgtggtggtgggcgcctgtagtcccagctactcaggaggctgaggcaggagaatggcatgaacccaggaggcggagcttgcagtgagccaagattgcgccactgcactccagcctggggaacagagggagactccatctcaaaaaaaaaaaaaaagaaaagaaaaagaaaaattagctgggcgtggtggtgcacacttgtagtcccagctacttgggaggctaaggcaggagaatcgcttgaacccaggaggcagaggttgcagtgagtggagatcaggacactgcactccagcctgggcgacagagcatgacttcatctccaaaaaaaaaaaaaaaaaaagaggctcaccagagaaaatggttcatttttaaacttccagctattgtggtctgcatatgacaccagagacatggcagctaccttgcagctatcccatgaagacaaaccctcaccttaaagaattgaaagttggctcaaagaaggagttgaaagttggaaagaacctaagtccttggaaatattaccaagcctaccctgtagccagccctaacaccagacttatgagtcaaaacgaagttcactttcttgatgcccaagtcctgagtcctcagcacctacaggagaaagactggtttcccactgtgcaaagacctgctgcagcccttagggtactgctccctggaaaccccaattctcataccatgctcacacaggattttgaggtgagcggggcatcctacccaccaagcagaatgtctttatgcactcgggccaagctggagtctgcagattagaacctgggtctctgaagaatagggtagctaaacccttccaggacttcacatggaacccatccatcagttaagttgttggaggcagaggtgggaaaccaacttagcttttaattttaattattctttaagtcttcatcacttatctcagtctaagcagagtttctaggctgatccagatttatgctccacagaggactgcgtatctgcattgaaatcagaaaacactctaaaaggcaacgtgatatttgtttatttgtactattaaaaaccacaggagaaaataccttatctggaaaaatagtttgaacttttactcacctcctcaaatctaaattgatatctaacacccattttccttgcaaaacaatagccggcagtagaaacagaacgtttatactaagaaatgttacagaaacctgagaagaaataaatacagtacttattttctatgtacactcactttctcctttaacatcaaagtgtgtttatatttttaaacactaaagtggaaagagtgattttattaggttcactccacccaagttcattgctacaatacctgactctctgccaaggtgcttagcctatcgctaggaagtcctaaacacaggcctgtttttaaacactttcaccactcccttagcctttccactttgaaaatattgtctggtatcatgtttacttctacattttaaacactgtttatatgtagaagtgtattttaattattgtcagcgattaatactattcttactatctgaatgtagattattctatatttcattaaagttgaaagtaattatatttgtggtttagctctaacaactgcactaataatactagtgataaaaatgcactcataaatcagtttgtataattattgatatgcataatgactaacaaaattgcttccccaataactctaatgatatgagagtaatcacctcctctcctaaaaataacacgctacaagcacagagaagtcccaacttatacacggattctgcattgtcaattatatgtgatggggtaaactaaaagagagtgacagattatctgaggtggaattaaatgatcaatgagccctgaaagacagggagaggagaacatacacctgcatggtaagagtacatcaacgggtgcccctctaacactcactagctgatacttttagctccagataactctgttgctttcagaccactggaggcagtaagctgtactatgatgatcttagggagagcagatgcaaataaataatatgctaaagattcagtcaccttattcctctacaatacatttacctgcattggtatctctcatgaaacctactcaaatgcagtcatgtcagcagttgcccactgcagctgaggtggtcccaatgcttcaggctcagagctggcatacagcacaccagatctgctcagtctcagaacttaactccaaaacccagaggctgacagagctgagttgctgtttctagaatgactatctcaagaaccgggcaaggcataatggaacccattagtaaattcagcagaagaaggaagaggcaggaaaataagaagggggaatgtactagtctgtcttcatgtttctataaaaaactacctgagactgggtaatttataaagaaaacaggtttaattggctcatggttccatgggctgtacaggaagcatggctgaggaggtctcaggaaatttacaatcatggtggaaggcaaaggggaagcatgcacatcttcacatggccagcaggagagagcaaagggggaggtgctacacacttttaaacaaccagatcttgtgagaactcactgtcacgagaacagcaagggggaaatccacccctatgatccaattacctcccaccaggtccctcctccaacactgtggattataatttgacttgagatttggatggggaaacagagccaaaccatatcacggaagttcagtctcataatgaaagcaaatctcataattatttttgttaagcatgcattcctctgttgactcaactaagactcaggctctgggaacttaaaatgcaccaggctttatctatgttaggagttatggggatatagaaaaataaggcatgatttggattcttggggagttcgcaatccaatgaggagaaagatgagtgtcttagtcacctgggctgctataacaagataccacagactgggtggctttaacaaatatttatttctcacagctctggaggctgggaagtccaacattacagctctggcagatctaatgcctggagaggcccgcttcctgctttgtagatggctttttgctgtgcctcacatggtggagagagaaaagaaaggcactggtccccttcttcatatgagggcactaagcccattcatgaaggctctactctcacggcctaatcacctcccaaaggtcctaccgcctaataccatggcaccggggagttaggatttcaacatatgaatttttaacacaaataggcagtccataaccacaagaaaacaactatttagttttgaatcaaatattaggtagaaccacacaaaattatgttaattgtagtgaaaaacagaaatatttgtagtcaaagaggtagcttggggccgggcgtggtggctcacgcctgtaatcccagcactttggaaagccaagacaggcggatcacaaggtcaggagtttgagaccagcctggccaacatagtgaaaccatgtctctactaaaatacaaaaagtagccgatgtggtagtgcatgcctgtaatcctagctactcaggaggctgaggcagaagttacgggaggaagaggttacagtgagctgagatcatgccactgcactccagcctgggagacagagcaagactctgtctcaaaaaaaaaaaaaaaaaaaaaaaaaaaagagggagcttggaaaaaatattctgggaggtgatggaactgttctgaattttgattgtggtggttacataacttattgcacttatcaaaactctcagaaactgtacaccaaatagagtgaatgctaccgtatgtaaatttaaaaataagttttaaaagcagctgaatatcagtaatttcatacggtttaacttagtagatgcgccagctcaggcagacagttctgcaggattgcaggaagcagagacgagcagagattaatagaggagtgatagtctcatgaacaacaaccatttcatcagagccttgaaaaaataaagccctcaacagtgaagaaaagaagggcaagaaggtaaatatcctagagacaaggacagcacaagcagtcaaaaagttctacaaactcacagcaggtgtggagaatagcaaatagagcagtagatagttcatgaaagcagggggatcacaaaaaaaaaagggggtagaatacggaggacttaaaagaccagattaaatacactagaatttattctacagtcaatggcaagttagtaaagtgtttagacaaaggactgacatgactaaatctattttggaaagataaccttgataaaaatatggaggatttgttggttgtgggaggtatcagaggcaggagaatgacctacaagggtttcttaattggggtctgtgaatttcttaaaatggttgcaatattgtgtatgtgcacacacatttgtacatacacacatctttttctagaagggggtctatggttttcattagctactgaaggagttcataacctccaaagggttaagaactttaagaactgtattgttcaagtgcatcaagatgcagcaggagttaagtttgcagtgagcagaataaattcagagacacttatgaagatcgcatttctggacttaaaaataactagtgagtgagagtgagagagggaggatctaaagatgacaacaaagtttctagcttgctgacctgggaagtgttgagggagaggaagggagagggaggaaaaggggtatcattacactaagaacaaaaaaatgatttcacttcaaagaactgaatatttaacctctgcacttgtgtcactcttagctggagattttcttctatttttatgggccaaagtatttctggctaaagagagagataagatgtactacagaggaccgtacttgcatatgaaaataaaaagcagatgagaaaacaatcttcaaagcctttctcagagtgagttcgctctccggaggcttgctttccacattctcatggcattaggaaacctcagggggatggtatctgcctctgtcacacaagggaatgaatgtaacatatagtattggaataagctgaagatagccatccaaacagtattaatatgttttaaacgtacaaaacatttcatatgacttgaggatttttgtaagttagaaattcgactcactagcatggattacaccttaaataaatatagtttcttccctggtgttttcatacatcatggagcaaatttatatttatttggtaaacatttgcttattaaataaacgtttgcctgaagttgaaaggggatgctatatagagctcccctaattgctctgttagctcatttgacctccagaggccctgggatccaaagagctgcacccccacctcaggaagcctggagaaagccaggcagcagcaggacagtgagattttgttcaacaaatctgtattcatagccagatactataatgggggttggaaaatacaaagatgtgaggggctctcagcttgtctgtaatgaagtgatcagggcagggcaagagtgtcagattcagtcatgtaggagcagccctgtgcagaaagaaccccacggccagggagggaggctccagggaacatatggctgtcaccatatgggagtcgagagggctgagaagacagacctccggggagagtatctgaggcttcctaaatgctcatacctcaatttatagcagagtgctgtcacctgaattccactcacactgctctgctgggtctcctcactaaagcaagcacacccactgagaactacggcacgcttgggccatctggcccctctcccacaccctgcaacacacacacatacacacacacacacgcacgcacacacatgcatgcacacacaggcacacactcaccaactgaggtctgtgaacaatacaacctcagtcagttgcactgtttcatttgtacatattaccgtaaccaacaaatgactgcaaaaaaactgttgttcaatgaatactctggaaatgcatgatggaggtagactgctaaaaaaaatgctgccaaatcaggtgtgaaagacattatctgtaaaaaggaggaaggaaaattgttaaaaagaaatctaccagatttccaggtgtccttaagtccttccaactgtaatacggctgtggttaacagaaaaacaaagatgtggaataaggcagatccatattaaaagaaatagcctgggacttctgtcaaataactggtgagtaaatgtgcatttctgtgtatgtaattaaaataaaatgtttaaggaatatatggatcattttttttgagattctgtttactggccaactactataagaattaaccaaaaacctaatgattccccaattcctcttctacataaatttaacaacctcccactgtcagccaacatcactcccattaccagttaaactcccttccaactggaaaatcattgctctgttactggtctttatcaaagatgatttccaaaccatacaatctcatttactgtgatgtagatttagctttacttgttaaaaaggattttatactaagatttaaaccttaaccattgccaaatcttccttcagtttgcccagtaagatttcatacaacctagaaaagaatttagagcctgaataaatatatgaagtgctctagcaaagcactttcttagtgtttgtcatcaattatattccagttgcaaaattttagatattgaagatcatttcaaaaaacttttaaaattaaaatttgaatgcaaagtatgtagctactttctttgttttggtatatggcaatgtaagatactagagagtaaaacattcaagttgtaactactgaaattaaatttgataagaaacttgtccttttattgaataattactttattcatgttttttgaaaaatgtattcagttggaggagctgtcctctttttaaaactgatgctttaaaatccacgttataaaaacattactaggccaaggcgggcggatcacctgaggtcaggattttcagaccagcctggccaacatggtgaaaccccgcctctacaaaaaatacaaaaattagccgggcgtggtggcaggcacctgtaatcccagttactcgggaggctgaggcagcaaaatcacctgaactcgggaggtggaggttgcagtgagattgcgccactgtactccagcctgtgcgacaagagcaagactctgtctcaaaaaaaaaaaaaaaaaaagatcatagctctttcttcagtgtcttaaaatatcaatatattagtatataatatatctctagcatttttgtaaggtctcagaagccctatgaaatgctctgggttggcacttgatctttacacacaggattcaacataacagagcaacttgagaagacagaactggatttcctgaatgggtaatgagctcctttacatttaattcactggaggctaacatcatccttaattaaaaaagaaaaaaaaaggtactattaaaattacatttacttcctacaatagaaagccaaaatggaaactaccagagcttcatgaattttaaagccctacgcaaacgttgttgcacaaacacaatttcctctagtcctagaagttttgctcaagttgtattagctccatacaacctgacctacttgttctaaaatatttggttgcaattcaaagatgggattctttcttatggatcccacatttatagagcaaatgtacctaaatgttaatatatgttcatcataaattagattaaaaactaactcaagttaattttagtatgtcattatacagtattaactaaacaattaggataaaccactacaaaacagtgagctgtgacatcatagagccatttcctttcaagccctacccttaatccactcttccacctgccaatacacacacatgcacgtgtgcacatacgcacacagaaccccccctccaccaccacctttcatggtgtatttttcaacccctttagagaattgacaaggatagaagacatttaagattaaggtccataaagtattcattattgttgttttctgctttctttaagaactgtctcgtcctatcaggacacacagctatgctagctcagctgtaaacaaaaggatacgaccttgaaggtgtctatagctcactggttttagatgccgactccacatcttcatcacagctcctaggtggtggctgcactgatgtgtacaataagataaactgaatcgctagctgaaataagcattttgaattttcatttgtatgtgagtggattcaaaagattaaagtgctatatccataattacatgctcactactattaaaaatacctaagctaacttctaattaaaagggtggatagtacatgtgtattacctcctctccctcctgaacccctgccaaaaacaatatataaggccacaaagaagaaaagatccaagtgaacaagagatgcaacacttttcagaagatggaaaatgaatacagaagtagttataggatgagaaatagcagaggctacagaggggaagaccacacagaaacaaatttgctctgcaacccaggctccaggcttaggggagcaggacccaaccacaaagggaatagtagggtgggtgtagggctgagaacaggggagtgaatgaatgccagcatatgcaacacttggatccccagatcctgcacagacactttctcccctgacctgcagagacagtttctcccaggaaaagagctggcttgctcaagagcttccaatttgcttcctagtgactcactgggttttctggtggtaaaatacacataacataaaatttaccatgttagccattttaaaataaacagttcagcgacattaagtatactcacattgttgtgcaaccgtcacccccatccatctctgggactttttcatcttcccaaactgaaactctgtacttatcaaacactaactcctcactccctctttcccccaaacccctgccattctactttcttctctatgactctgtctactgtaggtacctcatgtaagaagaatcatccagtatttgtccttttatgactgactcacttcacgcagcataatgtcctcaaggtccatccatgttgtagcatgtgttagagtttccttcctttttaaagctgaataccactctatagtatgaatataccacattttatttatccattcatccatcagtgggcacctgggttgcttccaccttttggctattgcgaatatcgccgctatgaaattgggtgtacaaatacatctttatatccctgctttctagtgattcactcttacatgtgaacagataactaaggatcagaggactttttaggaaaacttcccaacgttaaagacagaaaccaaaataaataaggaggaagggctcttgaaaattaaaatggtataggccaggagcagtgactcacgcctgtaatccgagtactgtgggggaccaaggcgggtgggttgtttgagctcaggagtcccagaccagcctgggcaatgtggcgaaaccccatcattacaaaaaattacaaaaaaattagccaggtgtggcggcacatgcctgtagttccagctactcgggaggctgagatgggaggatcacctaagcctggggaggtcgaggctgcagtaagctgagattgtgccactgcactcctgcctgggtgacagagtgagaacatatctcaaaaaaaaaaagtataaataaaaaaggttagatgggttggaaaataaagtcatagaactttcccagcaaatagcgtaaaaagagagatcaaacatagtagagaaaagataataatcaatgaagatggtccaacagcaaatttataggatttctagagagaagaaaggtgtttatcaaataaactacgggagatatttcctcccaaaacgatattggtatccacattcaaagggccttccaagaggcttgcaaagatgaaaatagaccatacaaggcacatcgtggtgaaatgtcaccatgccgggaataaagacgctaaaaccttccagagcaaaaagcaggtcatgcaaaggtttgggacacagaatagtatcaaaggtctcaatagcaacattcagatgctagagtagaacaatgtttttcaaattcagagaacaataccttttaagctagaattctgtacctaagcaaatcatgaatcaaaaaagaggcaaacaaggtctccatcagaggagaggagcagaaaagtcccaggaacaggggcagcaggcccagagggcattaggttggtgggcacaagggcacaggagatgaaagcttctggcctcacactatgggtctgtagctttgtttctgattgattcatgcagtcatacaacagtgttttttgtctattatgtatcaggcactcttcccttctaagtgctgggaacagaggtgaaaaaaacaaaagttcctgtcctggtgcagttttcattctaaggcgggagagggacgataaacaaatataccttgttaggtaatgtcctatgaggaaaataagcagggaaaagggatagggtgtaaccaggtggagtgctagactggaaagaccagaggtgaccttggagacctgagtgcagtgagggagagagccctgggcattttgggggtctggagagagagctcttaggcagagggacttcaggaccagctgccctcatcagcctggcctcctgacaggcattctccaatggacaagattttctcttgctcccagcctgttcatttcttctggaccctctgggaaacaactctgcctggaggcagatggcagggctaagcagccccaattaccacatggctggggccctattgggccagtcctctttccccttcccagtgggggagatgacacaagactctgcaagagagatgggaccccagaagacagaaaggatgcaagtggttgagtgctaaggtggtaagtccaggccctgaagccatctaggcagacacaacatctgacacttacactgctctttctgtgcattttcacaagcaagagaggcagaacaggtaccaccatcatgcacagatgccgaaactggggcactgccaggtaaggaacctgcccagggtcacagagcctgttagttacagtacgaactctcactggggcctgcttcagagaccagtgctaggtcaaaaccaaacgtaaacatgtttttcttgttacttttcatgttttccatacaggtaaaaataaagcccaagttgtaagtggttcatgagaacagaagatctttttatttagcatttcacaaaatataaggctactcctcttgagacttcaccttgagctgtaattttctagctacccatgggtcagagacaggcactagaacttggttagacttactccacctcagattaggagcaattaccgtttgggaaaagaaaagcaaactgaaggatggaacagtctacctagaagatgtttcaatgatcggataactagcattatgactagttccccgccagaatatgccgcctcagccttcccttccaaacgctgcaatctcctttccgttacctatcttcggggttgcagttttgttctaagagcagaggagcatttgcatctgcggggcgaaggtgctgagtgggaggagcggccactgcatgcccacagaggaagctgctgtgacagccctgctgctcctgctgagcaagggaactagagtggcccagtctccacctgggtctggctccgttcccgaagctgattcaggaattgagtcatcattcgcaacctgaagtcaaggaacatcttaattagatttaaaacactgtatttcaataatatctaacagtttaaaaatacccccacatttaaccctcagcattcctgcgtgagggaaacacagtggtgcctgcaatttacttgaaatgagtaaaacatgtgaaatggacagatggatggatcggcagatacgtgataaaacaaagtaaaagaataaaggtagaattcaggtattggatatatgagcgttccctgtaaaattctttcagctttgttgtagttttgaaatcttcataataaaatgtcagggagagtgggagggagggactctcccatcatcctggattatttcaatatccatgtgaatgattaattcaacaacccagcctcaagcttcctggccctctgaatgccggcactctcccgtcacctcctggaccttacctcacttaaaacagtcctgccttgatcttaaactatctcttcagaccagattcctttcattccagctcactgcctcataggtgcttccgcttcaggaaggtatctacacctaaaccctccatttccccgtgacttctggtgcttctgtatccaacagagatttatcagccccctcagcaccttccctgcaaacctgcagggccagccactgtcagggaagaggaacacaggggcaggaaacaacctcacagcccctgcctgcagcaagctcatctggagctgagagtagggacggaggagatgtgtgggcacagctctcacggggctttgctgccatggttcctgtgggcttgcctgtgcttctctcccctgctggatcccctcttttccaccgctgcatcttcccggatagctcagtttactctcattttgatggatcatatttttcaacagcttaaacagtttttattatgaagtattttaaacataatcaaaagaagagagaatggtataatgaacccacatatacccattctcaacagtaacaagagtctggcatatttgcttcattatcccattttttttctttttctttctttcttttttttttctccatgacggagttttgctctcgttgcccaggctggagtacaatggcgcgatctcggctcattgcaacctccgcctcctgggttcaggtgattctcctgcctgagcctcccgagtagctgggattacaggcatgcaccaccccgcccagctaatttttccatgtttttagtagagacggggtttcaccatgttgatcaggccggtctcaaactcctgaccttagatgatccatccgccctaggctcccaaagtgtcgggattacaggtgtgagccaccgcacccggactttttcttttcattctttgctcaagtattttaaaggaactcagacttcttcagtgtgcctctcttaaactccaggcctgtaatcccagcactttgggaggctgaggtgagagaactgcttgagtctaggagtttgagaccagcctggtcaacatagtgaggtcatgtctctacagaaaatttttaatctgttttcaaatgtatttgcagagttgtgcaaattaaaatataagaaattaatgcaaaggtcagctaaagttgctgtctattaatttgatatttagtagttttcatttgtaaattaactaactcttagactgcaaataaacatttttgtaaagggctatgtttttaagtttctaagaaaatcttcagttagcagtttagagtcttctaaaattaaagtagaaagaaataattggtgtgaaaatgcaagggttagctgtgttagaaaatgtctaattgagggttgtaagtttcttctatcttgagaagaataaatattttgaagagtaacattgaaggtggcatgtttaaaagaaattaaatggttattataaaccacaggaaaaatagtagaaaggaaatggtaacagaacaatcaaagaaaagcataatgggataataaacaggttaacagtgtaataatgataattaacagtaacaagatattgttaaaattttaattaaacttaaagcagcagcaggaaatactgaaaaataaaatacttggctacataaaaatgtacacttctacttacttctaaccttataaattctaaaagaaaaaacacaaatggtaaaacacatatgaaaaaactgtttaatctgaacagtgcaaaaaatgctaacaataacactaatgaacaatttttcacactgcaaatcaccacagattaagaagactgacatttttagtgtgatgaagacaagttccttccagcttttgggaaggcagagtggcactctgtgtcaaaatgtaaactgaccataccccttcacccaccaaatctatttctagaaattcacccacaaaagacaatcacataaatgttcaaagatctatctattgaagcagttttcaaaagagtgaagattaggaaagacttatccactaataatggatagggtaaataaacaggtacattcacaaaaatgactactgctacagtcactgaaaatgtaaggatgctggagaaagtcacataataaagaaaatcagtgccactataattcatgatcactgctcccaaatgggtcctcaattccctttctctaaccgcagactcacaggcccttctgctgatgtgatataagctctcctatcagcaataaacaggaatgaagtattgatacatgctacaacatggatgaaccttaaaaacagcatgcaaagtcaaagaccagacacaaaggaccatatattatatgattctatttacatggaatatcccaaataggaaaatctataaagacagtagattagtggttgcagacttgggatggaggtagtagggggtgacagctggtaatgaaaatactctaaacatgactgtggtgatggatgcatattcaactctatgcatgtagtagtatattcaactctgtgaatataatacaagccactgaattgtacactttaaatgagtgcattgtatggcatttaaattctctcaataaagctgttaaaaaccaaaagctctcccatatgtggaatgtttgcgtgacccctgccacctgagtaccctcatgcttacagctaaacatgcctatgtgttattctaatgtgtgtgagtttcaccactggcatgcaacaaatcagctctatattcatttgttactccacctttctaaaaagctatctgacatattgacagtacataatgacagctaaaatttcttatcctttaattcagaggtgatctttttgaaacctttaataaggaaatacaaaaactaaatctgtcacccaaactggagttcagtggcacaatcactgctcacttcagcctcaacctctctgggctcaaatgatcctcccacctcagtctcccaagtagctgagactacaggcacacgccaccacacctagctaatttttgtagagacagggttttgccatgttcctcaggctggtctcaaaactctgagatgggctcaagtgatctgcccatctcggcctcccaacatgctgggattacacggatgagccaccatgctcagccaataatttttataattggaaaaaactgcaaaaaatctaaatgtttaacagtagaagaatcaataaaccataatatgcccatacaagagatagcaaaaagacattaaaatgttttcaaagaatatgaactatagagtgttcatgatgtataagtgaataaagcagaacataaaagtgtatatataatgtgatcccttttatgtatattatacatttctacaacaacatggatgtgggagcacctactgccttctctgaataccatccctttccttgagagccactgtcttggtgtaatgtgaccacactgcctagtctcaggagcaggggctaatctggggatggggtgggctaatgacaggctctttcccagaaatctcagccatgagattcaacttggttgctctcctaaacggagatcttaaccctagggccggtttgcaagtcggctgcagttagctgttatctaaggaatgctgggaatgctggtaggggctaggcccacggggcagctctgactcctccccatagtcccagtgcttaaattccaaggtacttagcttttgctgaaatgctggggcaggaagtctcccagaatgcagtggctgtgaacagcaaggctaatcccatgggaatggtggctgtgtctacctgtgccagcagttccctgtagcatcttcttgttgaacccactccagtcacaggaaataatcagagagctgattatgctatgcaaacaaccaggggttgtggcagtctacaatttccaaccacttgtctaaagcgtgattcagaggggcagcaaccagtcctggtcaccacaagctgttacactttctgcaggctgggtatgcaaaatttacctttctttcagaatatactgtataattttacttggaattcttattctactctcacagcatgttccagatgtcacacagcatgaggaagcaagtgctctccagcccaggatctgatagcacccacatctttgaggactgaggacagagggcatcaggaagccctgacaactctggcacatctgccaccaggtgtgtggtgaggtcatgagggcagacactcaggcgctactcctcttcttctcctggttactcaagaaagctactcagtacttccatacctgagtttcctcatcttcaaaagggaggttacaccctctaagccgtggcattcaccaagaggctgggacattattcttagaaatacacaaatacacgcacccttttttctagtatgggctgttcttaaaggtatgtgtcacactgagtcagcaggctcctgggtccataggcaggtcagcagtctctgacacattctccttcagctcttctgacaggtagaccttccatttttacagctttatggaaggatatttcacagaccataaaattcaacactgaaagggtaaagttcaacgcttttcattattgacacaagcagatcttgactgtcacagagagaaagataaaaaacatattagctcctttctctagtggcctgcatcctctgttccctgccatctcttaatctttccctccaataatgtttgcctgggcatcccctctaacccacagccactttcagacccctcagcagcacctcctggtggccagcaagccttggagggagggagccgccagctagtgcagcagttagctcaccatgccaggacccacactccccccagtggaataagctctatgctcagacaacagacttaatgaaaaccaaagaaacaaggataaaaatgaggtgaaagaaatagaagtgtttttgtgaacttttaaagtacagtaaataagtctagagtttataagcaaaagctgatatttttttaaaagagctttactgcataatctttatccttattcccacaagcagtcaaaaatcccacaaccacatgaacctatcaaatagtaaagaagcatttgggaacaagagctaggcgcagaagctcacacttgcaatcttagcactttgggagaccgaggcaggtggatcacctgaggtcaggagttcaagaccagtctggccgacatggtgaaaccgtctctacaaaaaaatgcaacaaattaaccggacatagtggagcatgcctgtaatctcagctactcgggaggctgaggcaggagaattgcttgaacccgggaggtggaggatgcagtgagccaagactgcgccattgcactccagcctgggtaacaagagcaaaactccatttcagaaaaaaaaaaaaaaaagtatttggggacaagaaatgaattaatatgtgtgacggacaatgacttaataatacctaatctggttctactttcttcatcttgatttctacttttgattgcttcttattgtaaggaatattttcaagacatattttctgtttctcatttatttttcactggtcatattttctaatcctgtcttcactttggtgtcttctctggattttagtagtgaaaatgactgacacgttttgaaataaatgttaaaaagataaaaagaaaaactcttgcctgaaaaattaccctagtattcaagctacttgtgtaaattacagaaatttaaaaaaactctagataatataattatcagatagaagttctacaatgagtacatttgaaattattaaagacccaaagaaataaaaatcccagggaacaaaaggtaaatacaaagcatagaaaaacatgatagtgaggtgggtgcatcacctgaggtcaagagttcaagaccagcttggccaacatggtgaaaccccatctgtactaaaaatacaaaaattagctaggcgtggtggcgcatgcctgtaatcccagctattcaggaggctgaggcaggagaatcgtttgaacctgggaggcagaggttgcagtgagctgagatcacagcactgcactccagcctgggtgacaaagcaagactctgcctcaaaaaaaggaaggaaagaaaaatatgatagaaatatatccaagtacatcataaatcacaagtataaataaataaaatgtgtccacttaactggatgaaaatttagaccatgtaaaaagaaaagtaaaccccacaaaatccatagagacacatgcagatacacagaggttaagagaaaaagaggaaaaaataaatatactggaggaatttagattctgagactgaaggatgagataattcagattaactccccctctgaacacaactggaaaaaatataaaggatattttcttgaaggcattatagaatcaagaagatggtaaagaatggccaagccaagatactggaagaatggaggtctgagaaggtgagccacgcatatggggccatcttccccttggggcaccttctgattctggagagcatcgctgagcaacaaggactccatccagggctgaaggcacataaattggaatccaaggcccccgaaagccagggagcttggttaatttggactgggatcctgaaggggtactctttaaaagcaaagaccaaccagaagttggcaggccctcataggcactgcagcttagttctgaatcatttcagtccttgaaatcggactgatgttaacccagattgctactgctgccaagtgcccaccagaaacaaacacaaacccatctcggaggagaaatatctatcatcctagacctcaatttatttttacattttttcaatctttagataactcaatcaaaaataaccaggcatacaaacaggcaagattatatagaaaaaaaaaaccactagtagacaccacaagcaacagaaacatacccacaattgctctagatttagagcaaaagaactatgtttactatattcaacaagataaaagatgagattgttttggcagagaactgtaaaccaaaagacgaaccaataaacatgcagagaggctcaatatcattagtagttagggagatgcatattaaaactaaaataaactactagtacatcccaactatgatggttaaaaatttttttaagtgacaacgacaagtgttgctaaatatattgagtaattctcataagctgctggtacaactataaattgtttaagccattttagaactgttcggcaatatctaataaaactgaacatatgtgtaacctatgatgcagtgactctatggcaaggttatacatccaacagaaactcatgcacatctacatcaagagacatagacaagataactcctactcgcaaaatctgatcactagaaggaaaaatagataatcttactctcacaatagtagagttaaaacacacacttgtcggccgggcacggtggctcacgcctgtaatcccagcactttgggaggccaaggcgggcagatcacgaggtcaggagatcgagaccatcctggctaacacggtgaaaccccgtctctactaaaaatacaaaaattagctgggcgtggtggtgggcgcctgtagtcccagctactcgggaggctgagacaggagaatggcgtgaacccaggaggcggagcttgcagtgagccgagatctcgccattgcactccagcctgggcgacagaatgagactccatctcaaaaaaaaaccaaaacaaaacacacacacacttgtctcaataaactaattgatcaagtagagagaagctgaataacaaccaataaacccaatctaaaggaaatatgtagatccaactagagaacccattattttcaactccacagtcattaaagaaaaagaaaaaatgcaaatttcaacaatgatcaaagaatctttatcatacaatttacattatttaaacccaataaaatcagaaatcaaggacaaaaaaaaatcttggaaatttatggacacagttttaaaaaatcataggtcagagatgaaaccataaaggatattaggaaatacttacaactttaatgacaatgaaagcactaactattgaaatatatgggattcagctaaaccactacttagagagaaatgtagagttttacgtgtgtattagaaaagaagaaagcctgaaaaccaataatttaaatgtatgactcgggctgagtgctgtggctcaggcctgtagtcccagctctttgggaggccgggggaagtggatgacatgaggtcagaagtttgataccagcctggccaacacggcaaaaccccatgtctactaaaaatacaaaagttagctgggtgtggcggtgaatgtctgtaattctagctactcaggaggctgaggcagaagaatcacttgaaccagggaggtggcggttgcagtgagctaagatggcgccactgcactccagcctgggtgacagggcgaaactctgtctcaaaataaaattaaaaataaataaataaataaatgtatgactcaagaagtcagaaaaagaacaagagtataagataacaggggcagaaattaatgaaacttgaaacaaaaaaaaaatcctgatttttaaaacagcagcaaaactgaaagctgcctttttgaaaagactacaggaaaatagagaaggcataaataggaatgaaaaaatgattacaactacagatacagctgacatttttgaaaaagaatactatgaacaactttatgcaatacaactgaaaatttagggaaaagtggacaattccaaaaataagtaacattaaaattcagtcaagaagaaatgtaaaacttgaacaaacctactaaagaaattgatccagtagttaaaaacctattccctcaaaataaactaaaaataaacaaataaaaccctggacacctgccctagatggtattatcagcaaatcatatcaaacattcaaaatgcagataatctctatttacacagactattacagatgacagaaaaagaaattattcccaactcatataatgaagctaagaaaacccaaaaaccaagccaaacaagtacagcatgaacatctcacttactaacagattttaaaaacctaaataaaatgttagaaaatacaattttacaaaatcttaggcaacaccattgtcaagtacaagttatccaagtaacacaaaacaatatcatactagaaaatactttagtatgattatttaattcatcacattgacagactaaaggagaaaaactgcattatcatcttaacaggtacaggaaaatcactctttaaaattcaacactcattcctgatacaaacacctggcaaaccaagaccaacagaggatttctctaacctgataaagactacctacaaaaacatacagcaaatatcatacttactgatgagacattagaagcagtccctttaaaatctggactaagataagggtgcccactatcaatcacagcctccattcaatactgtgctgaagtgcctgacatggaagtaagacaaaaaggactggcgtaaggattggaaaggaagaggcaagtctgtcataatgtgcagagaataggaaagtctacacagaataactaagaaaatctataagttattagaattaaaatgaaaggttcctggttataacctgaaaatacaatagtcagttacatgtctagacatgagcataaaaataaaaatatacagctgacacttgaacaatgtgagcgttaggagtgctgaccttcatgcagtcaaaaacccacctataactcctgactccccccagaacttaactactaatagcctcctgttgaccagaagccttaccaataacgtaaatagtcgattaacacatattttgtatgttatatgtatataccgtattcttacaataaactagaggaaagaaaatgttgttaaaaaaatcatatagaagagaaaatatagttactgttcattaagtggaagtggatcatataaaggtcttcattcttgttgacttcacattgagtaggctgcagaggaggaggaagaggaggggttgatcctgctgtctcaggggtggcagaggcagaagaaaatctgcatataagtggagccgcactgttcaaacccatatggttcaagggtcaactgtaagtcatgtacaacagcaaaaaaactatataacaaatcaaactagtcacacaacataaagttttattgaaagtaattttagaagaatagagagatgtactctattcacatataacgagtccaaattataaagttattaattttccccattctaattctatatgttcaatgtaattccaaactcctgctagggttttctgtgtggaatctgacagattgataattataaaatgtataaagaagatcaaagagccaagtacaaccaaggcaactttcaagaaccgcctaaggtgggaaagtacttgccctactgttagaggaaaggagtcccgatccagaccccaagagagggttcttggatctcacacaagaaagaattcaggtgagtccgtaaagtgaaaacaagtttattaggaaagtaaaggaataaaagaacggctactctatagacagagcagccccaagggctgctggttgcccatttttatggttacttcttgaatatatgctaaacaaggggtggattattcatgcctaccctttttacaccatgtagggtaacttcctgatgttgctatggcatctgtaaattgtcatggtgctggtgggagtgtagtagtgaggaccaccagaagtcactcttgtgaccatcttggttttggtgggatttagcggcttctttactgcaacctgttttatcagcaaggtctttatgacctgtatcttgtgctgtctcctgtctcatcctgtgacttagaatgctttaaccgtctgggaatgcagcccagtaaatctcagcctcattttacccagcctctattcaagatggagttgctctggttcacacgtctctgacaataccagctttcaagatttgttatacaattatagtaactaagacaggtttctacacagggagaggtaaacagaccaagggaaaataagagagaaacaaatccacacatatatggaaacctggcatttgacagacatggtattatagatcagtatggaaaggatgaaacacccaatatatggtgctgagacaactggtaatccacattgaaaataacaaagcaatctctacttcttgccacatccaaaaactaaatttcagaataaaagactcaaatgtaaaaagcaaactttaaaactttaaaaaaaatatgggagaacatctttatgacctggaaaaaaaagggttttttaaaacaagacattaaaataaaagaaaccataaaagactgataaaatgactacattaaaattatgagcgagaagcagaaaataaaaggtaaaattactgacaagaagacatttccagtgtatattaccatcaaaggactaataacagaatacacaaagaactcctacaaatcaacaatcttctctccaaacaactattttcaaaagtatgaaaagcctccatttttgttttcattttgaaaaatgaattatttaggctcactgaaaatattcttttccttattgtaatttctaacacagaattctaacactgattttgaatagtattagaactattgaaaacaatttaatgattaatacatttgaactgtttttatgattataaaataatgtgtaactatgaattttgtaaagatatcaaaatacacatttgaaatatttaattaaaatgttaaaattaaaaagaaacaaatgtaaagagcataaaaatcattaaaaatccctcatgcatcacacacacacattttgtcaatattttggattttttctttactttgtttctattaataaatacatatacatagatgcacaacaagctgggtccaaagtgagggtggcttattcaagtgatgacatccatcagtcagtagatgatgcaagctaatgcttaggaaagaggtgaggtctggggatgttgacttgggaggtcatgcttagagcaataaaagttaagactcagtcttggatgaagagattgtaggaagaaaataagagtgaggacacaatattagaataaggagcagaataatatgttgggaaaaataacttgaaaaaagagaaagtacaattagataggtaggaggagaatcaggatattgtggaagaatgtcaagaagaagataacattcaactgccaatcctgaaaagaagttaaggagaatgaatcctaagaaaaggccaacatatttaacaattgagagagacggctgtggagtaaacgtctgattacaggaatgcaaagaaaacagattgaagggatagggatatgtgcatatttacaccacacagtcaacaaatctggccagaaagaaaggtggcaaatcaagctttttttcaagatattagagatctgttatctgtctaccttctctgggcgagaagcccagtatactgaaagactaaagatgctgggaagagagaagtaaacaaaaacacaaatgcctgaaagcagagggagaggatggactttaaaagagttctggatcatgacttgtcatctgacacaggagaaaagaaccggggtcacaacagacatagttcaagctgaagaggacaggagaaacctctggctaggtaaacttagtaattttagtaccaaggtacgtcacgggacaaaactcaacttaaatcaagaagcatccacactaaactatacctaagggcttataagagacgaaaaaaaatccctcattatgtctttgcttcaactcacccatgacatgagaaccaatactggtatttgggtgaagcttcaaaacaactgaaactatggggaatgtttcaaaccagttaagcactgacataaatgactgagaaactccggtttccttaaaataagcaaaatattcatttgttttgatattattttttgatgatacaagtgtccatctgtagtagctagtcaataaatattggttcatgctacctgtactgaatgtttctgtgctacatggtcaattgcataattgccagtttaaggtacagcattaagagcaaaacaattcacggtgaaataccccacccatgttttcctacacatctgtgattcaacaaggaatgtaatgattcacagtattggcattaagtttatattgaggttgcccttttgtaactgagaagtagggctgggttgtcactgtgatcttcccaatcccttccacatccaaaccctcacttcccttctcagccccactttgaatgacgccaagttaaaacactaatgtagacatcctctgtcataaagccaacaaaccagagaaacaagaatgcttattgacctccttccttaactacttcttaaaaagggatctaaaatttatgagtaataaaattctaaaaagaacatttaccttctatgtgtatgcataactaaagcctacaactgaaatatttggaacttctaaagtagttttcaacttcaaatacaaacttatattagagacaaaagccattagctttgctatgagtagtgtgaagggttgatgtgacttgaggaagcaaagtttgcaaagattttcatttgactgtagatttacaaaatgtttaacaatttcagttcctgaaatagtcaatataggttaaaataaattagtaagttaaatgtggaagtctttaaggtaataacaaagcaaggccatcagagggaaactgagaattatctctctcaaatatctggagagtgactgtcaaaatcaagtcacaaagaaattactacattcacattattccgtgttccacagatgtttcttctattgctcacatgaactcttttctctttgctttcacactcaccagtaacacttgtagatctcctaggtcatttgaacatttagcattcaactctttgatcagttcaaactgcctccacagaacatctttttctttcaagcgttccttattctcaaaatgttccttgaatttcaaccaaatttaaattccttacatttaccttctaaactttgtattcacctcctctgttccaataaacaggaacaactctctaagcccttgtgtcttgtagcaaccattgccaggcattttcttaaaattcttacacctcccttgaggtgctggtagctttagaaatgtcgccggagcagcatgaaattagccatgactaggacaggacagtcaggaattgctgaagactctcatgcctgcttcaccacctatggtcattacaaaggacttcaaaattcctggcttttccagtcctggaatgaccctgatccctgccccattcctatagcacaatcccaaaaccatacatggtctttctcaccacagttcccctgccaatctcttaaatgctcacatctaatgcttaggccaaggctcttgtgttgcacaagaggtcccctacacccccgttcctgctgacttcacctccttgcatcaacaatctggtctcctgggccatcatttcaatcaccctctcacctttaatcacaactatttccttcctttgtctttctccacataccacccttcaaaaccagcagtgccagctctccactgccacccccaggcagatgtgctttgctggagagagtgacaccagactggccctggtacagtcctcaacatgttcctagccagggttccctctccttttctggtcctcagcagcaatcctacatcatcacctctctgtagcatccccaccttctccctcttcctcaactggcaatctcaatgcccactcagggaatgaaactacctcccaaccccaaactggtctctatatgagttccctcctcgctgggggtttcctccctcctatgcgctagagtccatccatctgtcccatccctacagcaccagggccctccattctccctttccctctggtatcttcgaagactctccacagccatctaaagatactcaacactctcccacttaaaaaaaatggcacatgttaaaaattaaagacttctatagagaacattaacacgccactaaatactgaatagagtcgtccagtcagtcttcatcatctagctcctctatgttgccagcacctgtcagtgcctgccttccccggtccagcctgttgtagacattgtgctcattccttgtttcttgtttcttcagccccagaaccttcctaagccatcctgaccaagcctttgggcttcctgtgtctgcatctacagggccacccgccggctctccaaactgaggctttcttccccacatctgcagttctgattgctcaactcttggcttggtttcagattagtactccaggtgctgcagtctgactaaactcccacttactgcactcatgtccaatcagtgtcctgacaagacaccagctccttttccctgggggtacaaaccttatctcaatcccgcaaattattaggggtccccgtgctcccaaattcatgtcactaccactaactagtggaatgaagtactgttattgcttacagaccgctctactgggttcataagatccaccttgggtttatcaagttcccttagaaaatatatttagaacgctggcagcccagtggagtccagctacacagctcggcgcgtttaccctgggatcccttgtttcttgtttcctttcatttccttctccaaccaatttcccatcatacctatgggcaaacacccatgttataacaagcaattcattaactacttattttaagttatggtgaagtgttataaccataatatttataagtgttatgaaatttataagttctgaaatttacacaattctttcagtggttagcaaaccatactactattatagactctattatatttcataaccacatattatacacaacatgagaagatctctgtttaagagtcccacctatggtatttgtaaaaccattcaatcaggcaaaaacaaattaaaaaagtaatatcagatagtaatacactagaaaaccaaaccttgaacaaacatttggggatccccaggcttacaaatgtattggtttctattgggtaaagtcttggctttctcattttatatcatttaaacaaaggaactgaaaattatattttaaaataaaaaccataatctaaaactaatctaagaaaatactgagaaaaaatagcagtaaatttatatattttatcttctgtaatgaaaactaaggggaaaaaggcatgctaaaagcaactagttctaaagtaacttcatgaatgtaccacacagaatacttaacagctttaaaaagcagttatgaaatgcccatttgaacatcagatgccacggacagaacaagtatccaacctaaagcagacaacacggacccactcaaagatatgcagtgacatgcagagtcgtacttcacacaatcctcatttggagaatgagtcaagaagggcagcagcgcgaccctccaggcttttccaaaatgaccctcctgataactgaggagctccagctgggctgttcttttgccctggttcaaaatatacctagatgtggaaaagtacaaaggcaagcatttcccatccactagaaaagaagttcaattatcaaatgctaaatctaggttacactaaaaaaaattagatgaattaaaatgtggcctgcctcaaagcaagagcatgtcttaccaatcttactgtatctcacttaacatactcaagaggaaaagaaattgaagcatttaagtagtccatcttcaacattctgctgtgaatacaggacctgtaatatgcttgttctacttgacatataaaaagaatcacatttatgtggaagcctaaggttaaaacaggtttttaaaatgtaaacagcagtaacatgaatgtattgaattacgtaaatcccaaaacttttcatgccacaatggtatgggaaggtcggtgactgactcacctaaataaaatgcagtaagtcaaagtatatagttagagcaaaaggaaaaagataaaaacattttaaaaactaatttatggttttaattctctataataaatcttttaaaaattaatacacagtagaaaatggagaaacaaagttaataaatgcttacaaagatggcttatgttatattaaacatgaaaatgatatcaaagcataattatgaaatcgtcaaaaatcacgtttgtagtacaagtttacagctagttttaaacaaagaattttgaccaattacttgcagaaagtaaacaagaaaaaaagcttgacttctttctgacagcacggaagtccttataaaacagagcactatgtcattcgactaccaccccccagttatcacagttcttggtatataaatcaccttcgaataagcacagggtgtctgaaatttccactctgccctaagtaacaccattcaaaatatcaattgcttccagcaattcgaacaatgaaaataactttaaattggaaagattatcccactttcatctccacattaaagtccatccatcataaatttaagtagagttatggtgggcaagacgtagcaagaatgaaataaagtattttaaccacaagagacccaaacaggacttggcaacgcttcctaactgcacacgctagaaagccctgcccccatgtggctgaaagtcttgcacagctggccagcttgccctggggcataagggagaaggttcatccccgaaattgccatgttaaatgcccacttctggctgttggaagatttaggataccatctactaagcagaaaggatacctttttcccaggctcagtgtcttggacaatgtgaacacacaactaataactgctggattatggagacaacagcttgtgtctgcataatgccttatgtaaggttccctcccacggatgcagcaaacacggaacattcaagttctgagatgatgctgaggctcaatttaaatggcatctttcctgctctcaactctactttcctggtaatgcttcatgacatacgatcttttagtcattattcctaaataatagtgccctgtcagtactgggggcaaaggacgcatcttggcacttggagcttttgctattctctctccacctggtacacactctgcagtctgtgaccctccatttccacctccagctgcctggagtctctctgcgaatgcttcaattccctctggttcacagcccaaaccagagcctacacctgatttaccattagccatttcccaagcctgtactctgctccccaacccctagcacaggctcagtgactctgaaggtgaaagctggcagcaatgctggtgagtcataagagaaggcaaggaaaaataccacccagctacacaccatgtgctatggtcagaatgtctgcatcctccaaaattcatttgttgaaatcctaaccacaaaagtgatggtattaggaggtggggcctttgggaggtgattaggtgctgggctggagccctcatgaatgggattagtgcccttacaaaaaaggcctaagagagcttgtttgccctttcaccatgtgaggactcaatgagatgatgtctgtctaccaggaagtgggcctccccagacaccaaatctgcgatggcctgatcttggtcatcccagactccagaaccatgagaaataaacttctgttgtttataaccccccaaccccccagtttatgatattatgttatagcaggcaaaaagcattaagacaccatgcacttgaataacaaactctggaaatagagccactgtcaagcctattagtgactctcattgtgagacttccagaataagcaggccgtaagatattctgggggaagactgggtggggtttatgacagcatccaagtcaggttcggaggaatgggccttcctctaacctacaaagtcataactagaaagaacttaactatagcattcacttctccacctgccataggaaagaaaagagtaaatcataggggagacaaagtgattcctttcctcttggtttataaagcctgcccagagccagcacacagagcgtgtgcccatgtcacaggtggccctccccttctgcaccaggtacacagtcaggcctcacgaaacattagctactacaaaatgtaggacttacccaaaaaagaacatgtgtagagatagaaaacaacatattctgaaatgtccatttttcattctaatgctcagcagtcatataataaccagatgaactaagctgctttcatttagacttttgggaacagaatggtatctgtttcaagacaaatacaaccaattttctatctatacttgaaattacgtgtgtgtgcatacagacagattcactatgttatttatatgttcctcagggatgatttactgttccataacaaacgtggtgatcaaatgattctaatcactgactgaaaagtaatgaaataatctaagatcatctctgaaaagctgaagcagatccatattagataaaaaagaatgacttccataaatcgactcattcaacacacaggaaagcattctatctttatatttctgtatttttcaacctcctctggcctgcttgccaccccactgcccatggcctatgtcaccaatcacctccaagtgacccccaccctcgcccctgccccgatgaccaccataaccacagcacccagagatgagtccactgcactgtgccactttcacagatgggggaggaagagagctgtaactgtcagaaatacatgaaaactgtcaaaaatacatgccatcagctctggagattttgaagcactgatgtctctctgttctgtgaatgtattaaaaaaaaattacattatccctcctttcaaggttagcaaaaataaaagatgaactctacttccacctctgcaaatgacctcctacgaccgcaggcaggcccacgctgcctttgccttccccacctgcttgaggccacacacatctccgtggaccactcctcccttccagaaactcccctgttcgcttcttcagcctctacccaggagtttcctttgctggcccctcgccttctgactgcctatgcactggtgaggttccctggccctgccttagtcctctctctgttcacaaaaccatcctagcagtaaaatcctttttcccaaataaaatggtctgtgctcctcaccctccagtagaacagataaaagcagagctactctggctgaaggggggaaggaggcttgaggccaccctcatggggcatctctacagacctctagggttgggaaccaccagcagtttccttcaaccagctggtgtgagctccatctccggtcccccctctgccccctcaacacctccccactttttgcccaacaaagtcatatgagtccttccagatccagtttcccagccaccttgtttgtgattctttatgtacaaagtagctttgagcacttcgttatcccccaaggcactctgcaccgcctccaccattgtacacgtatcacgtgtttgtttacatttttgccggctccactagattgtgaccattttaaaggcagacaagatgatgacaatggcgtgcatgcgtgtatgtgtttgcatgtgatgggacaggggagtctcagatgaacctaaagttaggcttaaactgctctgggtgtgaggctggtgcactggtctgcatgaagaggccgtgaggagggaagcgactggagaaatggggaggagaggtggctgcggtctccatgcccgcccaccagagctgcgtctcagccctagacagagagggtcaagcaaaatccaggaactgctttcatgagagacttcacaaaatatttgttaaaccagaatactgaacgcataatattctcttctttgaaataacattttctctattcttttcattaagacccaaatttctaaaaggcctatattttcttctcagttctgatgaataaaattctgcctaaagtcagagtcaataagctcccgaactagcagttgctaatgaaaagaaactctgaagagatgagagatgatggcacaggtcaactggaatggagacaaaatactgagctgcaaaaccgatccagaaagcccactaggtggagatgaaggccggtaccactcacaagaatggagtctttgcagcctttgtacttacaaccattttttaaaacaagagttcttgcaaggttgtctagaagactcctttagaaatatctgaacattcacagtttaatcaagaaagtatccattaagggcaaaaatctcctaccaattagttgtcaattggcaaactgcattcagactggcctctggaactcccaaagttataaaaatagctggattcctttttctgcaaaagagcctcaagtctctctgactcctctccgtttggaagattaataacggtgataattctggaagactcctttaccacacagcggtgcgtacctccgcagagggctggcagtgggccacagcacactctgatgtcccgtgcagttcactgacacccaggttagcaacacaggctgtatgctcagtgaactggggctggcaagggcaggcccggggggacctgcaagggaggggacttgttcataagcacctataagaaccaactcccaagtcatttttcttttcttccttttttttaagtgaatactctctgtattttggttaatcaacaatctttagcacccattatggacaaaacaatatgctgcacacataccaaggatacaagaaggaacaaactaccctggcctgtgctctgatggagcgcactttctcctggagacagatgaaagaataaataaaataactgcaagctgtgataagacactggtgaaaccaagaccaccagctcaccaagtaacactagaagatcgccacaagggattttatatgtgtaagagagagagcgggtgggcatcctcttttgacataaaagatgatggagaaggtcttttttaaaacatgcattcagtcaaatccatgaatttagctaatccttctttccctaagtgtgcaattagggaaaacctaatgactactttacaagttatagttttggcttcttttgctatttattaaaaacacagccaggcacagtggctcacgcctgtaatcccagcactttgggaggccgaggcgggtggatcatgaggtcaggagtttgagactagcctggccaacatggtgaaacctcgtctctactgaaaacacaaaaattagctgggcatggtggcgtgcgcctgtaatctcagctactcaggaggctgaggcaggagaattgctggaactgggaggtggatgttgcagtgagctgagattgtgccactgcattccagcccaggctgacaacagtgagactccatctcaaaaaaaaaaaaaaaaaaaaaaaaaggcaatattttcaggccaagcatggtggcttatgcctgtaatcctagcactttgggaggccaaggtgggcagatcatctgaggtcaggagtttgagaccagcctggccaaaatggtgaaaccccgtctctactaaaaatacaaaaattactgggtatggtggcgcgcgcctgtagtcctagctactcaggaggctgagggaggagaattgcttgaacccagcaggcagaggttgcagtgagccaagattgtgccactgcactccagcctaggtgacggagcgagactccatctaaaacaaaacacacacacaaaactaaataagactaaacaaaaattttctacctgttaaggtacttaaaggaaatattttgtatgtaaaaattaaaaatcgttagaaaacaggtacttgactttaaatttatttatttatttatttatttattttatttatttttgagacagagtcttgctcagttgcctaggctggagtgcagtggtgcaatcttggctcactgcaagctccgcctcccgggttcatgccactctcctgcctctgcctcccgactagctgggattacaggcgcccgccaccacacccggctaatttttttttgtatttttagtagagacggggtttcaccatgttacccaggatggtctcgacctcctgacctcgtgatccacccgccttggcctcccaaagtgctgggattacaggcgtgagccaccgcgcccggccttgactttttagtatcacaattttgacctagtgaatactgtgaccagcttttgttggtggggggacggggacgggggcaccaaggaatttatgaccctatgtttataaatacagatatctgaattggaattacaccaacactggcaacatcttattgacaaaatattttaatttcataaagccaatataatcccttgttcaattttctctaaagtacacgaaacagctaattttttccttcttcaactgatcttttcctgcaattattttcactgagataaggcttttctaagtaaattttaaatcaatcggattttacctacttcaaatatttaccaattatagcttctgtcattatgaattctctctactggcaactgctttttgtttattttataaagtccaataacctggatcaaagtctgaagattttaaatctgtcatgaatatttcattcttttgttgatctgaattcaaaaacaaattttactgtattaaatatcagcaaatgtcaattttaattttacttcttctgtcagcttttcaactgtatgaggtttgactatgccacttaacccagtgtctgtcttgttttatgttgactatttctaccaggaattgtcattatgaaatattctacaggactggtctactttaataaaaatccaaccctcccacatacttgtacacttgtgatcacttgggatctcatactaaccttcctcactggtgagtaactcccctctggtgtttcaagtatatggtcacggagacaagggccaggtcaaaatgtccccaagaccaaaaggtctaggccctaacactggagccaaatgttcagtgcatgtgtagacaacgtgtagcacaagtatgtgcctaagtaggaattatgttagctaggagaatctggaaaaagtaagaacttttattctaagaatcaccagctgatattcttttcactaatttccaaagagaaagacatagccaagtcagttggtgagatttcaacaagtacttatcgagaagctgaaactgccctacaaacttcattacttcaaaccattccatttgagataagagctcctctactctctctcactaaaacctcacttgccaagaattcccccaaagccacatggaggcccatggcagcacgaaacccaatgcccaggatactgggcactggtgggcagaggaggatcagtgtgcttgggagactacttacactgagccaagagtaagtttgacagcaacaaatgaagggatgaggacagggaaagctaggtttctcactactggaacacagaaagggaggaaagctagaaagaactatgaggcaaggaacggaaataggagtaccagtgagaacttaaggctattaaacacacacacacacacacacacacgcacacacacagaaggacacaggttacagatgataatgtatatgtgcttgcatgttcatttatattcactgtatcttttctgctgtctgctgagagggcctggaagaaatgtacagtacatcaaagaaataagcacactgaaccccctacatcacggtttctaaatactccatcaaagggaaccagagcctccttgaagaaaaggcttattccaggactggggcaacaaaagtataaactaaacctggaacacaatatgcagaaaacaaggaagtgttcaaagattgaaagggacatgtcacaacatcaggagagccaggctgaaggagctcccactgtctaaatcacaggtctccacgagttgacactgttacaaagaaatgaatgacaatgcaaattaatagacaagagaaagctttttactacagtggaatgccaactaataaatgcagaatgaatgaaaggaatatgaaatcactatttggcaatcagcatagacgtggctgatttgggcaggagtcatccgtggaggccagggctagtggatgaaagtctgatgagagacactggtgtaatcttgaaacatctcaccacaaaatactaatgaattaccaagaggaccacatggtgaattaagtgtgagagaatctggcagacgcaacatgcccaggccagcaaggttaacctcagggcatgcgccctgatgcgaggctctgagaagcacagcatcatttccgtggtatttcttcccaggatgcatggcctgaatctgctcatgaagaaacactcgatggacccaggctgaaaattctttaaatttgtcaaggccatgaaggacagggaaaggccgatttctgtttccattttcagtgcccctttcatggcctaactgccagcaaggccatttattcacttaatcatatctattcattcatttgacaaatatttatactgagctgcaccaaacccttaacattatgccaggtattataaagcaatctaattttatggcacataagctgtcagaaattggggaagcaatatgaacacacaaattctaacataagggatcctgtaaggttgcacagtaaaacaagacttcctgaatgagggataattcggggagcaatttgtcctagatagacaagttttcataagtctaactaaaaatgctactgcaggcactaaatctttttgtattttaaccatttggctgcatttttttgttgttctaaaatatattactcactttcctgccttcgtaaactgaacacaatgtggtcattattttatgcaaattttagttgtataaatctaaatcatgcaacataaaatattaataaagtctcacttcatgaacacacctgaaattatgcaaatgtcccaaattaaaactaagcacctagaattacataattttaaactggcaggctgagtgaattaacctgtgtgtctattactggtccatggcaaaccgatttatctgaaaacagaaataagccaccatacttgtagcttattgagagtcctatgggaaaaatagtctcagaatcataggaattttgaattatgcagacacctcagatacgtatctctgaaaatgccatgacagcaactataatttaacctatttatgagttggcttctactgtggcattaattttctggtctgtgagttaaagacttgctgggaggtctggcggagcagaccctgctagttacctacaaagtacccgtttcctccttcttccttactagcagaacccattttcatccctaggagcctgtgccaccaaaactccccattttccaccctcccttagaacagaaaatggcaatgtgatgcaattcttgccaaggagatgtagagagatgtccctggggagggcatctcccctgaaactaaagggcaaagcttcactaggagaaagttttctgaccctttactctgccccattatttttgttagaaatacagcatgtgagggcagagtcacagcagccacctagagactggacgaatgagggctgaggcctataaaacgagggcagcctggaacagtgcggaaggctggtctctgggaacatcacagcacagctgtgccaaccctgggctgccttcccccacactccttgctacaagagaaaaatgctcctgttactttactttaaatgacaatcatttgggtgggcacggtggctcacacctgtaatcccagcactttgggaggccaaggtgggcggatcacgaggtcaagagatcaagaccatcctggacaacatggtaaaaccccatctctactaaaaagacaagaattagctgggcatggtggtgcccgcctgtagtcccagtcactcctgctgaggcaggagaatcgcttgaacccagcaggcggaggttgcagtgaggcgagatcgtgccatcacactccagcctggcaacagagcaacactccatcacaaaaaaaaaaaaaaaaagacaatcattcaatcaaccaaaggcactgagtgatatttgaggattatttatttgctcctgtcctaaacagtcttaccttattaataccatgtcttttatcttttatattcttatggccattatttatggagtctcagacttttcctttggtcaaagaacccagctaagaaaatcaatacatgacattcaccaggccagagcctggtccagcataaggtccagtgagacagaaatgagaagtaggaaagagaactttaggggaagttttctatgcttgaaagagagccacagaaagagacactgcccctggcctttatccttgtggacgtgaggcctgaactgctgcccatggcatggcacaagcctaccgaggaagcctacgcagaggaggggagatgcaaagtatcccaggaaaatggaaccagacccacaggattcaattagccctgaagaacatcctactgcagaacttctagtatataacttaatatctttattatttagaccagtttgagttagtgttctgttatttgcaaacaggaacatttcaacgacctcagaacgtgaaagactcagcccactgtaagaagagaagaaggctcaatcactctctacctccacatctactactaataacacctccaccaccacctcctcctcttccaactccaccaccaccaccccctccaccacctctaccatcacaacctactccttcaccaccacctccaccacttctaccctcacaaacacccaccaccatcacctccgccacctccaccaccacctctaccaccacaacctactccttcaccaccacctccaccacttccacctctacaaccaccacctccacctccaccttcaccacctccactactacctccaccaccaccacctccatcacctccaccaccagcacctccaccaccaccacctccactttcaccaccactacctccaccttcaccaccacctccaccaccaccacctccatcacctccaccgccatcacctccaccaccaccacctccactttcaccaccactacctccaccacctccaccaccaccacctccaccacaaccatcttcaccactgctacctccaccaccaccacctccacaaccaccacctctacctccacaaccaccacctccacctccaccttcaccaccacttccaccaccaccacctccacaaccaccacctccacctccacaaccaccacctccacctccaccaccaccacctccaccaccaccacctccacaaccaccacctccacttccacaaccaccacctccacctccacaaccaccacctccaccttcaccaccaccacctccacctccaccacctccaccaccaccacctccacctccacaaccaccacctccaccttcaccaccacctccaccaccaccacctccatcacctccaccgccatcacctccaccaccaccacctccactttcaccaccactacctccaccacctccaccaccaccacctccaccacaaccatcttcaccactgctacctccaccaccaccacctccacaaccaccacctccacaaccaccacctccacctccacaaccaccacctccacctccacaaccaccacctccacctccaccttcaccaccaccaccacctccacaaccaccaccaccacctccaccacaaccatcttcaccaccacctccaccaccaccacctccacaaccaccacctccacctccaccttcaccaccacctccaccaccaccacctccaccaccaccacctccaccaccaccatcttcaccaccacctccaccaccaccacctccacaaccaccacctccaccaccaccacaaccaccacctccaccaccaccacaaccactacctccacctccaccaccaccaccacttccatctccacctttaccaccgctacctccaccaccaccacctccttcactaccacctctatgaccaccacctccacttccaccttcaccaccgctacctccaccaccaccacctccttcaccaccacttcctgtgccaccaccaccacctccattaccactactaccaccacctctacctccaccaccataaccaccaccacttctaccaccataagtacaccatcatcaccaccacctcctcttccaccaccaactccacctccaccatgacctccacctccaccactaccactacttctaccaccataaccactcaatcatcaccgtgtgcccagagcagaggagcccacgatgctccctgcagtttcttccaggctctcgtactggtgatgggagaactggtgataagagtgggagtgagaacgggggaaggggccagtcccttccacagaactgggaagcccagaagtggtgtccatgtccctccatggactttctttctaccgtgttctcaccatttcatgcccagctcccttctcaccagccaggcgcccatggtggagaaaaacttaggatgtgtttaaagtcaaaaggcagttttgtgtcaaaacaggtccctgaggcctctcagggtcccaccagtctcatagtaggaagtctcgaggttacattctgtaaccccatatccttatctgtaaaatgaggctgatggtaatagctgtatctatttgacaaagttgttatgaggaggaaatagctaatgtaattaaagtgcctagaacagtgcgtggcatttagtgagtgccacacatagaatcatttgttaaataagttaaattgatcaattacatgcatcaattacatcaattacatgaggggttgagggaggaggagaaatttttcatcttcgatatcttcacagggttacagatatttcctgttagtctgcatggatactctttttttcttttcctttttttttgagatggagtcttgctctgtcacccaggctggagtgcaatggcatgatttcggctcactgcaacctctgcctcctgggttcgagtgattcttctgcctcagcctcccaagtagctgggattataggtgcccgctaccatgcccagctaatttttggatttttagtagagacagggttttaccaggttgaccaggctggtctcgaactcctgacctcagaagatccacccgcctcggcctcccaaagtgctgggattacaggcatgaacctccgtgcctggccagatgcttttttatatcaggagaaagaagtgtcttttcaaatcgaaaaaaaatcactgctattaaaaaaacaaaacaattattcaaggagcagtgacatgtgatttattaacccaaaaatgtactcaaatgtaacattccaaataatatcttctcacatatttccccctctaatgacaaaaactcctctaaagtttttgaaacatgtatcccttttgcctaatgattatcagtgatgactgaatcccctgtcactcaaggttaagggaacatcaccataaactgttaattggatcattgtttctattcactgcacaaaactttttgtagtatttttctgttggcagagagataagcagcaatctagatttacacccacaaagcaggaaataaactgcctaagtttatgttctagaataccttcctcccaaacagaatgaacttcacccaactggctccattcccctattttaggaaggaggtttaataaaagaagctgcaaaatttcaagcaatttgttaaatttttaaattatcacttaaacttctttgactatacacttagaatccaacaccagagtgaaatggaacagctaggaatgtaaacatcattcactaaatctaaagacaaaaggtcacttttctttttcatattgattgttatatgtctatcacccccagggggaaaaaaaagaacctgccatctggtttatgtaccattttactcattacaacattgaagaagggctcaggttttctaggcaaaacacatacacagaacagaattgttgagtccaggctatgcctaagagaattttaccaagcatctctgggacactgcctcaaggaaccagggagactggatggattccaatccctgtcagtaaactaggatgccaatcaattatcctgcagggttacaaaatgaactagaatgcccatcccatttaatccccacagagaaagctgaaacaatcacttctccccaggagtgaaatggcatcattctgatgatgcccgggaccaaagccaacaggctcagctggaacctgaggcctctcagccagaaactgggaccaggaaactacagcaagtggatctcttgctccacttgctatgtttttctaaaagcaataaaagttgtatttttccttagacaaatttggaaaaattaaaagtaaaatataaaaataaaaatagaaatattattctgttagttatacaaatttgatatgtatatatgccaggagattattaactaagtctaagctttcctatttcaaggttctgtatttactttggcagtcatagggagtcatacatttaatcagaatttttaaataaatttgtaaaatagtgtgtaaagttttcagagttgtttgaactgtaagaacatttacaaagtggtatctatggtggctaaggtacttcctaaaggaaataaagatttctattcctatgtaattagaagtcattacagatcctttaccaaataccttcccttcagacttctgtggctaaggttttaaattggttctacatgattatattacaaagtcaacttccttagaaaaacaattctgaatacctttcatcttctaagaaacccttttcgaatccatgtttttttcaaatgtgtagcccccctcttccttctttcataaaagaagacagatttttttttttttttttttgcaacggagtctcgctctgtcgtccagactggagtgcggtggcaccatcttggctcactgcaacctccacctcccgagttcaagccattctcctgcctcaggctcccgagtagctgtgattacaggcacctgccaccacgcccagctaatttttgtctttttaatagagacggggttgtgccatgttggccaggctggtctcaaactcctgacctcaggtgatccacccaccttggcctcccaaagtgctgggattacagacgtgagccaccatgcctggccaaaaagacagaatttttaaagtgtagggaaaaaaatgtttttagccccatgccagaaatgctatatgcccctacatattttgggtattacagtattaattgccatatcttatggtagaaagtgggaggagccaagctgttaagctcttcttatttattttttttattgcttggaaaatcagttattgcttttctaaaaatgaaacatgcgcattgtgaaaatttctaacaatctaaaaacatgcagagtaagatacaggaaatgtaaattgttgctccaccacgcatgacctcaaaaacctgagtaagaaaatgaacacaagttgcaaaaaactcaaatgaattgcagaaattagacttcattaatacattcccattgctgaggaatgaaatgtcagcataccaaagtccatggcttttcaatgcactcttcagaagtagaaaaccaaaatttaaaacaacatcgtccatgaagccaagggaaccattacaccagaacatacagctcctccctggaataagccttctgtgaacctcaacttttcctctcttttaacatcaatgttaaaatgcctcccttcagggatactaagacatttcacttttgagacagagtcaaatagaaaaaccatcaaaaagaaagaaattaattctgcacctgggtagcattattttttccctgcttggagtgtgtactaacttcaaccagatcaattctttcatgaaatgagggagaaaataaactctccataattttaaaacatatttattatgataaaaacatggctctatttgtcatttctatttgtggaaaactgaaggccatctttttctctgtaaagctttttgtctgctacattctagaaacattataacctctccaccaaccagaatgattctgtttatgcaaataaatatattttatgacatgtaaaattaattagttatatgattatgcttcagtaatgacaatgttttgcacaatagaaaaaaagctgataaaatttaaatttccatttttatattccaacaaataatttaaatttgtttcttgattaattcaatgtttcacttttgaaaagcaattcacttcattttgaagtacatttatattttctttagtcaccttaactgttagttctactcagcaagaatttactgtctttttattctttttctgttcttggttaaatgtcttctggtaggtcacattttacctatttatgtcttgtgtcataaaagcattcaagaacattttaaggtaaaatgcttgaataaaattattttagtaaaaatgtaaaaatacatgtaaaataaatgtaaacaaattaaaataaatgtaaaaaaaatagagtattggccgggcacggtggctcacgcctgtaatcccagcaatttaggaggccgaggcgggtggatcacaaggtcagtagtttgagaccagcctggccaagatggtgaaaccctgtctctactaaaaatacaaaaaattacccaggcgtggtggcgggcgcctgtaatcccagctactcaggaggctgaggcaggagaattgcttgaacccgggaagcagaggttgcagtgagccgagatcgtgccactgcactctagcctgggcaacagagcaagactccatctcagaaaaaaaaaaataataataatagagtattcacatttactgagcttttattttcagtagttatagataagagatgaaaaagacagaatttagtttcatactttgatgtcattttttgaaacaatggccgatggtacctttatcattcaaaatttttcaaaactcaaaggacagaaatgaacatatcaggtctaccaaataacctaaacattcattaatttgccattgaaccttatgatacaccaattgaaataaaacctttttacagcaaagaaaattctagtatttgctttatggcattacagtatcttttttattcaagtggggcctgaaagtgccagtgttcctccaaaaacatgcatgaatttaccacatttccatatgagaaataagaacctgtcacttggccttgaaaaaaatatgaccattaatgtaatcacttagaataaaaagaaagtgccaggagttcaagaccagccagggcaacatagtgagaccccatatctacaaaatattaaaaaactagccaggcatagtggcacacgcctatagtcccaactacttgggaggctgatgtgggaggatcacatgagcccaggtgttcaaggctgcagtgagccatgattgcaccactgcactccagtcagggcaacagaaggagaccctggctctttaaaaaaaaaaaaaaaaaaaaaaaaaaaaaagaatagaaagaaagcaccatcattaactgaattgggatccgtactaataatatcagagtaattattgtctggcactaccaggaagctgggtgtttggggttaatcagacacttaagtctctacttatattaacatgtggatttgtgattttataagatattcacattaatactctatcgaacttaaatcaatttttcttgtagaggtcaggaagcatttctctatcttcatatttggatcagaatcatcattatgaaccattttaccaatgttatcatatccatgctagttaagaaaacattctggttggtaaactgttgggtgaaccatttctaaaattaaaaaatgcctgccacaaaataagtctgctgcatttttatgaaaataataaaataaaaactttcatactctttggaaaaatgagaaaagcattgatcagtccacttacagtgagctcacagaaatccatgctatcaaggcttttgcttctgtgtaatctccctttaattcgtcttaaagagggttttccttggctgacactagaagtagcaccattaggattttcagaggatggcgttaccctgcaagaaagaaaaaaattcttaaaaaggcaggtttacaggtgaacacatttctcaagtttgaggtaagcatttactcaaaggcagctttggaaatgtcacactcctttttccagccaaaaagctaagaaccacagcagagctacattctatcagataccctttctaactatttcttagctagttaagacatcttgacaggattcaaatagtacaacattaagatttattagactgtgggtggtggctcacaccttgtaatctcagtactttcagtggccaaggcaggaggatcacttgagcccaggggttcgagcccagcctgggcaatacagggagaccctgcctctacatatacacacacgaataaaaaaattagcctgtcctggtggtgcatgtctgtggtcccagctgcttggaaggctgaggtgggaggattgcttgagcctgggaggtcaaggctacagtgagccaccactgcactccagcctgagagataagagtaagaccctgtctcatttataaggtttttttttaaaaaaagattcattaaatatcaattctacaactattgaagaagccattaatattagactgaagttttctaggtaacttaggggcatctgcttccttctgggcagttatttattcaacactcagtccggtgcctagcacacccagtacaagtgagctatcattgtgtccatcacagatactgttcagcatggttttgttaagcatgaaaataacataaatctaaacatgatagcacacacttaattcagcataattatggaaacatgaaaacacagacaacaagaagtagcaaatagtataagccatctataaagtgcacactggaatacatgttcatacatatacatacagacacagtaaatatcataaaatagactagatatggctacagtttagaataaaagtaatacatccatagagttaaaacatttgaagggtataaaaagatataaaaatggaaagtaaaagctgcccttttctccctcatcccaaactccccttttccaaaatcaaccactattaacagttgtttgtattgtataatctcccagacaaatgctcatgcttatatacagatgtgtttatttccttttcaatttttttaccaaattgtgtgtattgtcctgcaccttacatttttcacttaatatatcttaacgttcttcccataataatccatacagaactatttcactctttttaatggctaaatggtatcccataacatagatgtaatataatttgttcaactattcccctactaatgggcatttagtttgttttcctatgtttgttaccaaaccatacagcaatgaacatccttggcaacatctttgggtacaaatgcattatttagttaggaaagattgctcaaagtagaaaggcagagtcagagatgggagtttcctacatgctgataggtaatacctttccaaaaagctttacaaatttacacttccatcaacagtatatgagaatacccatttgggggagtccttaaatacaagggcaactttatcactttattatttttatcactcaacttctccatgtccttcattatatttttgtctgttgaactgctgattctgtataaaggactattgtaggatttcccaccttgaacatggacttgtcaattaatctatgtcttttagtttttgctttttatatttcaattgttttttattagatgtcttgatgtttatgacacatatcttcttagggatttaatcttttatcatataaaaagactatgccaattaaatattttaccttaaatgccattttgtctgatgataattttcccatctacatttttatattaaccatttcctgatttatcttgtgtttgtattttcaagtgttcgaagtctctctctctttttagttttttttttttttaagttgtacctttaactctggataagtagcatgtagctggatttttttctttctttacccaatctgagggttaatgtcttttaagagaaacttaatccattcaaatttattgtttttactcatatgtttagatctattcctgccatcttgttttgtgtttaatgctttcttcttaagtttctgccttattaatatgattgagtttactttgtcctcaaccaccctaagacctttttccctttccattcagtagtttgaaagttatacatcttattagggaaactctaactctagttagctatatacacacatgtacattaacatctttatatatgtatccatcacacacgtatatgtacacacacacacacataaactcatattttcctatcaacacctagggctcatgagtatgctcacctcctcctaaacaagaagtggcattagcacgtcttcattccccctctttcccagcaactccacatccctacaaaaagccccaccttcccttagaaatagtgttcaggtttcctggcttcttgttcatacttttgatctctttgctcttttgtgattctttaacttacttctccagattgcaaacttgcttttttagttttgtgaattcagccattgtcttttctatgaatcagtaaattctaaatttctaaagtagctagttttttttttttgtttttttttgagtcggagtctcgctgtgcctcccaggctggagtgcagcggcgcgatctcacctcactgcaagctccgtctcctgggttcacgccattctcctgcctcagcctcccgggcagctgggactacaggcgctcatcaccacacctgactaattttctgtatttttagtagagacggggtttcaccatgttagccaggatggtctccatctcctgacctcgtgatctgcccaccatcagccttccaaagtgctgggattacaggtgtgagctaccacgcctggcctgtatctagtatttttttaattaatgcaatattctcatgcatctttccaaaaataacctttttttcttctgaaaatcaccatctaatgtttttctattttctcaggagttagttctgtgttttaatttggtaattctctgggtactggctttcttgaattgtttggtgatttttaatgtctacttacatttgtattggaaaacatccatttccccactgcgactactgtggcctgccttcaggaactctggcagagagatgggatacgctgccaggtctgtgaggcagcttctcttgcaagtcagtagctacctctaggacagccctgcctctctgaccccagtgctccggacaactgtaacgttttctctcaacagatctatccctacctactagttacatttcaaagagtcctcaaaattacgggtccactgatgacattctttattgtttactcagattattattaattttgtcgtagctttaaaaattaattttcttctttcattgaatttctagggcgtcttcctttcaattggcctcccaaagtaaaattttactgatgccactttcatgattcttaggataaaaagaaacattgtacagctttgttctcttctccacagggtaaaagcttccatgaaaacaatgaactttattcaaaagaggacatatgggaaagaaaaatagagttataaaactaaatacaaatcaacttctcatttctctctcactttattttgatagcgctggtaggtgtgatcatattttagaaaattaatgcaaacatttaatataaataaataaatctgtctagtgttcttcgtaagtttttctctcatctgacttagaaaggcatcactattctccctttatgccaaatctagaagcctaaaagagcctgtaataaaaatttatatctaccaaattttataaatggcagatagtcaagaaatttaccagggttaactcaatgtaatactaaatccagtgacaaagtaaaacagaaaaataaaatgatcataaacaaaactagaagaatagatccactgccctccctaccaggatcataataaaaacatgctgtaatatcagcactttgggaggccgagacatgaggatctcttgagcccagaagtttgagaccagcttgggcaacatagagagatcccgtctctacaaaaaatacaaaaaaactcgccaggcgggattgcacatgcctatgggtcccaactacttgggactctgaggtgggaagatcacctaaggccaggacgtcgaggttgcagcgaatggtgatcataccactgcactccagtctgggcaatggagtgagaccatgtctcaaaaaaaaaaaaaaaagtaataatcagtagcgctaaagtggtgtataccaggtgaaaatcagctctggacctaccctgcccacagactccacaggaagatggtaccttgtctaagaatttaaccaggcttctacagagtaacttcaggaactttaaagctttgaccagatctttgggaagctgaggtaaactgttaaaaggcatatggctcaataatgacccccctttgtttggtgtggaataaagaaaagaaaaaacactgatctagataataatgcagaatattaactctggtgtaagtagaagtgctcttgtaggaataggtgaattttagatgttgcttctcttttgtttattactgtctttaaaaatatttgtcttggggaggggcgtgtgtgtttcattgttttctggacactcacaagaacacagctgcgtacctgtaactcaggtgagaagagctatacaaagagtccaccaaggacagttccatttgacatggaatataaattcttttaatcccctggtactactcttccccagccctgatggtgcagatctgagctgagtaactcagacttcagggattattccccgcatatttaggggaatggccctttatgacagggaaataaagttgggaactgatgtagggaaatcaatatttagcttacaatgaggttttacttttcctaattctttttttttttttttttttttttttgagacggagtctcgctctgtcgcccaggccggactgcggactgcagtggcgcaatctcggctcactgcaagctccgcttcccgggttcacgccattctcctgcctcagcctcccgagtagtttcctaattcttaattccattttatcctccctagagggaaggtggggagaaaacttctgcctctctccacctgctttgtaacttcccttgtgagagtgtactttacttgtgggcatggctgatatgcatcaaacgctgaagtccagggcccaccctctcgttccacttcctacccctaccggatgaacacagaccacaggcctggcccctggaggcagtcccccacttgatctgcccatttcccttctcttcacctgacactgctagaacaggtctggtctgcactgcagcctccaccatcatagctcccgaggtaagagaggaagcatcccctcagaggcttgcagaccagtgtggcctgctccagcacagcttcctagacagaccctcatttgggtgatagccagcacctgccccaatattattaacaacccagaaaactgttaacatttagttcttgttccttgaatgtatcttccctggtcaaggacatgcaggagaaagatatacaccaatccaactccacccattatgtcacacctacaaagctctgttgggcgctctgctggctacaggccaaatgtggactgctacatctttgacatgggactcggtccttagcaaagtcatttaaatctgacagagatacaaattttcactagtccaaaatacttgcaccacagtgcagcacaacttcttgacattctgcaaccatccctcccacacccttccctctgctggaatgcttttctactccccatccttgaaagcccaatgttcccaggaagcctcagatattcatgccttttgtttccaactcaggagctttggctacaaatatttctgaccattctaagacaaacaactcccaagctcatctacaccacccatttctaatttccagtggaaaagaactcaataataacacagaatcgggcaaaaataatcaagatggcaaaaacaaagcagtcacacaaggacaaatctatcaacaaagtaacatctaataatccttctacaagatatttgttttaagataccagcaactgacagccacagccaactcaagagaaggctaatgagtgacagcaaagctgtccccttcctccacttgaggggaattccaaacaacagtgtgagccaaggagctgtgagacactgctaagtacagaagggcagctggctttaaaaggatgctaaatccttctgaaggacacttcaggaaaagctagtaaaatgctaatttttgtttataagcattggacttcagaaagcttaataactcatgtaataggttaacagtaaatagtcatctgatgaacttagaaaaaataatgtgcacaactgccaataattaggtcatttaaaaaattgtgggctgggcacagtggctcacgcctgttatcccagcactttgggaggccaaggtgggtggatcacctgaaggtcaggagtttgagaccagcctggccaacatggtgaaaccccgtctctactaaaaatataaaaaattagccaggtgtggtggtgggcacctgtaatcccagctacttaggaggctgaggcagaagaatcacttgcacccgggaggcggaggttgcagtgagctgagatcgcgccattgcactccagcctgggtgacaagagtgaaacttcgtctcaaaaaaagaaaaaattatgaaaggacttgggtattggagcccttcacgtcccaacaggaggacctcagtgatccatgagtgggccgggggaccacccttggagaaacaaccttctatcgggcaattaccagtcattttagtatctgttttcagttattctctccttctagactgtcatctcactgatcaattgtcttttgaaccttgatcaattgtatgagtctgagcaagtcaatgacctaatttgtaaaaccgagaaaatacagcctcatggggtgctataagttaaataatgacaagatacttggaaagcactaatatagagtgcagcaagtaatagctcaatgaatagcaactcttattgtttttggaatctgattattagatgactacttgaatgaatatactgatagtgcatggccttaaataatcactgaatcaaataactggggaaatgtttttagagtataaagaaaatgaaatcacacccccttttctccctaagatcactgtaaatacttttttctttttgagactgagtctcgctctgttgccaggctggggtgcagtggcatgatctcggctcactgcaacctccacctcctgggttcaagcgattcttctgtctcagcctcccgagcagctgggactacaggtacgcgccatcacgcccagctaatttttgtatttttagtagagacagggtttcaccatgttggccaggatggtctcgatctcttgaccttgtaatctgcccgcctcagccttccaaagtgttgggattacaggtgtgagccactgtgcccagcccactgtaaatactcttaaagcacttagtgcaaaactcaagactgctgatagcaataaattatgaaaatatttttcacattttacattaaaaaggagtaactattatttgtgcctcatacctgcagaacagcagcataaatgtcaccttacttagaatgttaccatgtttagaaacaaagtctttgctgatgtaattaaagatctccagatgagatcatcctggatcatccaggtgggccctaaatccaatgacaagtgtccttataagagacagaggaataaggaagcaagactcaaggatgtcagaggagagctgttttagttgcagtggagattctaatatggcctgcagaagaatctgtctgcatatgtatacatcatattataaaatggagcatttattttatgagttcctagtttataatttgaaataaattaaaaattaaaagttttagtcttttaaaaaaagagagacaggagaagacacagagacacagagacacagagaaggtcatgtgaagacagaagcagagaatggattgatgcagccacaaagaatgttcgaaagaggcaaggaaggatcctcccctacagcatttgagggagtgtgaccctgccaacaccttgattttggacttctagcctccataactcagaaaataaatttctgctgttttcagccaccaagtttatgtgatctgttacagcagcccctgaaaacacaaagccccactgcttcttttcatcgctggcaattccagggtgtcccccaaaggaagccagcaggctctgcaaacttatacctacctcaggtagaggtaaccaggctttgttctgtgttcctaagtaatgattcagaaccaaacactgcaaacgcccctgctttctaaatttcttgaagaaggggatgaggaaaagagagttcctacaggctccactgatgtgggtctgactgtctgctttagtttccacctaagttggtctgcaaatataattctccttacgagatttgtagagccaatcagaaagacaggagatattgcacaaagaaaaactgacaggcacaaatgcccaagcgagatggaagtgtgggaataaggcatgcaaccctgccctttacactggcagaagcctttccatatagactgcagtaaagacagagaaacacagatatataaatatcttcatataaatcttcacatatgccttgaccagttttcataatacatcctcacatttatttatttatttatttatttatttatttatttattttgagatggagtcttgctctgtcacccaggctggagtgcaatggtacaatctcggctcactgcaacctccgcctcctaggttcaagcgattctcctgcctcagcctcttgagtagctggaattacaggcacacaccaccatgcctggctaatttttatatatttttagtagagacagggtttcaccatattgaccaggctggtatcgacctcctgacctcaagtggtccacccatcttggtctctcacagtgctgagattacaggtatgagccaccacgtcaggccctcacatttgtaaacaggcacaagctggtgcattccaaagtcttacaagcattgttgatgtctgctattggtttccacccaccactctagagtcaggacctacatcctactatcttctagacatatgatggtgccttatgtctccaatgctccatgtgcggttgctatgaaactagcaaaatgaaacattatctaaaaaataaatccaaagcgtataagagaaaaataaatctggcggcacaatgttctccaacttaagaatatgaagtattctacatctctgtttaaaagagccactcactccagagtcttcatagagcatacccttccctttgccgctgtagaatcagatgaatgtttgcaagttaacaatgagtggaaattaagaaatgattatctaagatcatggaaaagctcaacaaaagcctcttgccttttccaggccgcctcttagtaagatggtttttatccctggccctaactcactgcctacctcaaacatgaattgcttggatataaaagttacctggattttatttccttgtgtcctctcttcagaaattctgtgtttagagaatgtgttttcagaagcagaaccccaatgatggaaaataataaatatagtttcctaactttgtgaccaaatgctgctaatattgatgtctaataattcctcaaatattattcccacatcttgatttttaaactggcccgcgcgcagtggctcacacctgtaatcccagcactttggaaggccaaggcaggtggatcacctaacgtcaggagtttgagacgagcctgaccaacatggtaatgccccatctgtactaaaaatacaaaatattagccgggtgtggtggtaggcgcctgtaatcccagctactcaggaggctgaggcaggagaatcacttgaatcctggagtggaggttgcaatgagccgagatctgccattgcactccagcctgggcaagaagagcaaaactgtttcaaaataaataaataaataaataaataataaataattttaaactgaacattaagaaaacagatttcctaacatattatttcccaatcacaaattattaagaatccatttattcaacaaatatttattgagaagctttctggtacatttgtaccagacatccgttgcagggttttacagtaatggatgaaacaaacaaaagccctccctcatgcaacttacattttagtgaggagaaggggaatatatatgaaaaataagtaaaataaacaatgtgttagttattgataagggctcaggagaaaagcaaaatgggagatatgactgctggtgctgatatttcccatacccccacataccatcaatctgagaagcgatcttcaaatgttaccccttcttccttcactgtagtgacagtcttcatttatttgctaacatctcccacggacatgttttaattgaactgtggctaaccttgtcttctaagtgttgtcacttgctgttcatcacattaaaatatcttttttttttttttgaaataggagtctcactctcgcccaggctggagtgcagtggcatgaccttggctcactgcaacctctgcctcccgggttcaagcgattctcctgcctcagcctcccaagtagctgagattacagccacacaccaccatgcccgggtaattttgtatttttttggtttatttgtttgtttatttagtagagatggggtttcaccatgttggtcaggctggtcttgaactccagacctcaggcgatacgcctgcctcgacctcccatagtgctgggattacaggtgtgagccactatacccggcacattaaagtatcttttgcagaataaatttatttaaaaaaaaaaaaccaaactggtgggggcagaaagacactaacatttactaagcacctattattaagccaagcacagtggtagacacctttgtattcattatcagagttgatctgtgtatatccccatgagggagataacaagattctcactttacagaggaagaaacagacactccaggaacttaaggtcacacagtaagtggcacaactgaattctgaactttgctgtccatatttgtcttaccttcaaaattctccacttttaggattctttttcttaacccatctttttcttggctgatcacgctatatacttttttggtaaggatcactctttcacactgtcttatagagcaggaattactttcctcattacctaaaagcagcctcatctcctttctctacaaccttaggattaaattagactgtgctcaattgaattgaataaaacctttatgaactacactgaccactaattttaaaattaaaatgaccaatgccataactggcatcttttttctgtagtcatcttccctttactaggttatttcttttgcaaaagaatcttaatcctaaatctcaagccagtggcatacctaggtggctcctgggattccgcatggattacggattattattaataaaatgcaatatacaatcctgtagataatcagcaacgtaaaccagtaaggtccagacatttttctttaaggatgttttttcctcattacctcagtaacagtttccaggtcggaggaactggaacgcatgcaggtggaatacagtccctgacaatgcaataataatttcccaacttattccccttgccttgctcgtcctctactatgcactcagcagcagacgaatttttggaaaataactgaaaacgcacaccgtgataccaatgaattcttctgctgtctccgcgagagcctggctggaaattctgagccagaacccgccgtaatggagcagaaaggacagacagaggcgggaggccgacgcccgggtgcgggtgccaggcgtcccggccgctccccgtcgccctacgcgccgcgggcacagcgagggtctcggcgaaaccagtcagcgggcacgcggtacaaggcggcgctcggccctgggctcggccttggctgctgcgccccgcgcggcgcgccccgcgtcccgtcgggcccgacagtcgcggcctcgccccccgcccgaccgccccggccgccgctcgctctcccactccggcccccgccccgctccgcgcctagcccggctggggctccgcgcccgcgcggccgcctcaccacagcttcctcttgagcggcaggaggctgccgcggttggagggggtgacgccgatggccatctgcagcaccgtcaggtatttctggtacttcatcttgtccccgctccgctcgcgggcagggccccgccgcctccgccgccgccgcagacacagcccctccaggcgccgcatagatcagctctgggccatccgccgccaccacagctcccaccgctcccgcgcccgccgcacccgcagctgcggccgtgcgtggcccgggctcccgctcccgccgccgccgtcgccgtgcgtgcccggccgctcccgccgccgccgccgtgcgtggcccgcagctcccgccgccgccgccccttccacccctgcaggccgtggcccggcggcgcgctccggtgggcgggtgcgggtctcgcgggaggccgggctggcttggcccccgctccggagccgctgggcgaggccgggccacctgcgcgccggccgccctgcccaggccctgcgcccgcgtgccgcggtgttttcagcggctggcaggagctccttctcaaccgttagcacccaaagagaatcccaacagcacacttccagcgcggattaaaacaaacaaacaaacaacaacaacaacaaaaacgagacgctgcctgttggtttgtaactatcaattgatgtgttctatcccaaagtggttgacttcacattgacatataatgcatatggcgaatacgtactacacgcgcatgcagtcctcgcttgcacggtaattctggacgctggaaatgactgaaccatgcaaaactaccttaataatcactgggaaaaattaagattgtttcacgactttaaacagtttttctcaaaacattcaaagcagtccgggcacggtggctcacgcctgtaatcccagcactttgggaggcccagacgggaagatggcatgagcccaggagttcgagaccagccctgggcaacacagtgagacccggtctctacaaaataaaaaaaaaaaattagccaggcgtggtggtgtgcacctgtagtcccagcttctcaggagaatgaggggggagaatcacttgagccccggaagccgaggttgcagtgagccaaggtcgcaccacagcactccagcctgggtgacagagcaagtccttgtcttggaaagaacaaacaacaacaaaagaaccattcaaaactcgcttaactgatggttacaaataccctgtatatggaaatgaaaaaaaatcagtttaaaacattcaaacattgagaattaaagtattttttgtgtttgtaaaaataaagcttattaagaataacttgaacagtgcttgtcttcttctagtgtaactcttatataccaccttttctgtactttagcaaaacatcacatttggattacacgcaagtattttatcctttgcacttccaatgccatgcaatgtctcagagagttcctttaatgtaaaatgtttttgtggacctcatttcctccgggacatcctcatccttttagtcacagccattttcctcattcagtgtgctttgagtaagtttcactgactgcatatctagtctctggaaagtcagcactcccacagttgtctatttcttctatagtacttcatttgcattcaatttgaatttcacttcaattccatctttaccatttttttatttctttgctgcactttcatctttgttgaccaattccctttcaattattcatttttatacaatgctgtgtgagtttaacacttggagaaaaggaagcaacacaattgcacactttgctgccagtgcctaaactaacagtgcaatgacccgtcactgacagattttgaaagaactgctgtgattggtcactggttgttatggacatctattgtttacatagggttttgtggactaaagagctagaagcaaagattgtactatgtttgttcacagctaaaatagcatgataactaaaatttgttttttttgtttttgctttgttttgtttttgagacaggatctcatgctgttgcccaggctgcagtgcagtggcacaatcatggctcactagagcctctacctcccaggctcaagcgatcttcccacctgggcctcccaagtagctggaactacaggcatacaccactaagcctggctaatttttgtatttttattttttgaagagacgggatctcactatgttgcccaggctagtctcaaactcctgggctcaagcgatcctcccacctcagcctctcaaagtgctgcaattataggcatgagccaccatgccccatccagtaactaaaatttcaaccatattgttgagatactggtgttatttaactaaatagctgacatcagtcatatctgaacctgcaaagcaaaggatgcctatttggatatatgcatactatatatatgtgtgtatatatagtatatatgaagagtaccaataataagcacctatgcatccaccaggcagaagtgttaaccccctccctccacagtttatccctcctgcacctctatttaaatacttcatcttcaaattaattagcacataagattaaaacaacacaatcttcctggggtttgggttcccaacatgatttcacagtcacttaggtaggaaagcaggtctaaatatttcactttcatttacccagaaattttagctctcacataaaatgaggaattggcaggtttttgacacttcggttgtatactcccctggggagaggacatccttggagcagaacttttaagaaacatcaaggcctgtttttatatactcaccatgtcaaatatatgtttggccttttgcattactttgtcataataattgtaagatatttgatgaaaatactacactgtgctcaaagatttaggcacctggaagctgagggacctattcaggataataagcaataaaaataaatctgggagaagcacttctagagtggtagaaaatctgcttctccataaaagggagtacactggcaaaaatagttaaaaccaactccagaaattaaccaaacacaacaatccaaggagtatttattaaagaaaaattactgaatcttggtgagtacagtgagctttagggcattttgatctgcccaattctcaactacttctctccagctctacagtagcctagtaagccaacagcctcacaactacagtagctttgaaaaccatccagcagccactggatggggcagaataggtttagatcttctcaaaagccccatactaagtaaactgtcattatttgacctgtctggaagcaccttgaaaagttccattctcagggtttgtctttatttgacctggttcagaacttgctctgtgcaaacagccctatccctggtgcatttgttgaaaacaatcagttgcaactgtttaacatcacagatacctgcggtggtgaaactgtttggtactaacaagaagctaaccaaaaaagttaaaaaaaaatgggcaataagagtccatatagttccttgaaaagctctgacatatacctaggaatccagaatttcatgcaggacatgcatgtacatgcaggactgtgaacacacccaaaaaacacctaagaagactctaatctctcacctctgtctgaccttgagtttcagtacaatgcagaaaataaaggctaaggaagaatcgtaaactacctaccacaatgtgcaaggcatgccccagcacacacagcctctcagcaaaagctaggggatttattggctcaaagcatttaagaaaatatccattcaatcattagctaagcactaaactatccaagcagagactctaatggctgcacacaacaaacaatacagactttatagattagtccagcaaagtcactaaaccagcaacaaacctcagtggagaggaggggatatgatttctagagttgtcacattacattgttcaaaacatccagatctcaacaaaaaagttcacaacatccaaagaaacaaaattatggcctatatgcaggaaaaagcagttaatagaaaccattcctgaggaatcccaggcattggacttactgaacaaagactttaaatcagccattatgaatatgttcacagaactaaaggaaaccatgtctaatgaactaaaggaaaatgtgagaatgatgtcttactaaatagataatatcaataaacagaagttttaaaaaatagaaactctggagttgaaaagtacaaagagtgagatgaaaaaattctctagaggagctcaataacaacatatatgaactggtagaagcaaaaggcagtgaacttggagatagctcaattgaaattatccaggctgagaaacagaaagaaaaaagaatgaagaaaatgaacaaattctcagagacttatgggaaaccatgagtttatgtgtatattaacatgcacataaagtcccagaaggaaaggatagagagaaaggaatacaaagaatatttgaagaaatagcctgcccagactttatgaaaaacagtaatctgccatccaaggagctcaaaaaacttgaagtagtgacctagacacataatagtcaaactgttgaaagccaaagatgatgagaaaattttgaaagcagcaaaagaaaaacaactcatcacacacaaaggatcctcaataagcttaatagctgacttctcatcataaatcatgaaggtcagaaggtggtgggaagacatcatatttaaagggtggaaggaaaaatatccttcaaaaatgaaagagaaattatggcattccaggtaaacagaaagtgaatgaaatcatcactagcagacatgcactattaccaaagggaaccttgcaggctgaaatgaaagaatattagaaatttaaatccacataaagaaaataagagcagtgattctgataactacacaattgaatataaaaaattattttaatttttaaaattaaaaaattttaaattaaaaaatctgaacactctgatttaaaacacaactgcataaaacaatggctatgagctgtgtcgataggcttttaatgtataaacatacaatttgtttgacaatcatattacaaagataagagggacagagtggatgtatactggagcatagttttggcatgctattgaaattaaggcaagtcggctgggtgcggtggctcacgcttgtaatcccaggactttgggaggccaaggcaggtgggtcatgaggtcaggagatcaagaccatcctggctaacacaatgaaactgcgtctctactaaaaatacaaaaaattagccaggcctggtggtgggtgcctgtagtcccagctacttgggaggctgaggcaggagaatggtgtgaacccgggaggtggagcttgcagtgagctgagatctcaccactgcactccagcctgggcgacagagcaagactccatctcaaaaaaaaaaaaaaaaaaaagagagagattaaggcaaggcacggtagctcatgcctataatcccagcactttgggaggcctaggtgggagaattgcttgagcccaggaattcgagaccagcctgggcaacacagtgggacttcatctctagaaaaataaataaataaataaataaataaataaataaaaaattagccaggcatggtggcacgtgcctgtagtcccagctacttgggaggctgaggtaggaggatctcttgagcctgggagatggaggctgcagtgaaccatgattgtgccattgtactccaggctgggcaacagcaggagaccctgtcttgaaaaaaggaaaaaaaaaagaaattaagttagtattaatactacttaggttattttaagttaagaagctaattgtaatccccgggatgactattaagaaaatgattttttcaaaatgttatacaagaaataacaaggaaattaaaatgatacagtagagaatatatagcacaaaagaaaacagtaacagaagaatagaacaaaacaagatataagacatatagaaagcaaatagcaaaatggcagacataaattctaccttaccactaattacattaaaggtaaatgtactaagcattcccatcaaaagacagagattggtaaaatggatcttaaataaatgtataacctaatctttcactttgagcaactagaaagaggagcagaataaactcaaagcaaggaaaaggaaggaaataaggattaagagtagaaataaatgaaatgatgaataaaaaaacagagaaaatcagcaaaaccaaaagttggttcttaggaagtattaaatatcaataaagatgacaaaccttcagctagactgaccaagtgagagagagaactcaaattactaaatttggactgaaagaggggacattactaccaaccttgcagaaacaaaagtgattataaggagtatactaaattatgttgtcccagctactcggcaggctgaggtgggaagatcacttaagcccaggaggtggaggttgcagtgagttaagattgcaccactatactttagcctgggtgatagagcaagactctgtcaaaaaaaaaaagaaagagagagagaaagaaagaaagcaagaaagaaagaaaagaaaaaaggaagaaagaaaaaaaagagagaaaggaaggaaggagggaaagaaagaaaagaaagaagggagggagggagggaaggagggaaggacctacctacgtgaattagaaaactttctagaaagaccaacctactgaaattgactcaagaagaaacagaaaatcaaatagaagtataacaagcaaagagattaaattggtaagaaggaaaacttcccaccaagaaaaaatggctttatcagttttgttcattcctttatctcctgcacccagaacagtgcctggtgtatcataagcaaccaataaatatttgttgaacttgagacaggatgttaatataaagtgaaagacttcatgacttgtcataaggcatatcatttttctaaagaacagagttttgcatgcaatgtagataaatattacagctggaaaattgacatcattttatgtagtcaaagaaataaaaattcgctattagttctcagatgatagttaatgcttcaaaggaaaatgtgggagctgctactattggcactatgcaaggtccaaggtagtgtttttccaacctgcctcccagtgaatacaacctcaagggttatagcacctgagcctgttgctccaccttcctcaaaaacaagatcctttcacctattttgactaccacgcacagttagaagtatattttattttattttattttagatggagtcttgctctgtcaaccaggcttgagtgcagtggcgtgatcttggctcactgcaacctctgtttccttggctcaagcaattctcctgcctcagcctcccaagtagctgggattacaggggcccaccaccatgcccggctaatttttgtattattagtagaaacagggtttcaccatgttggccaggctggtctcgaactcctgacctcaagtgatgcacctgcctcggcctcccaaagtgctgggattacaggtgcgagccaccgtgtctggccagaagtacatgttaaatagtggcacagtacacacagacacatacaggcgtacacacagacacatacagacacacacacacacacacacatacacacacaactgaagcaaaagcttctgaaaacaatattttaccttactacctgggttgaacttttctgttctcttctacagcaagccactctacatccttagcattttgttggaacattctcatcagctcctatctttgcttgaagctggactgtcccccaattcagctgccctcggcagccctcagtgccccaatgctgccctcggcagccctcgacaggaggtgttttatctcttgcaccccacatgtctaaaggccagaggttggggtaagtttcttccttgttggtcctgccccttctaaaccattccttgctctttctcatgcccaaaccaaaccaaacaaccaaaaaaaactaaaaactggctgccctgaagtttatgcccttaaaggatattacctacccctttcccctcttctttattgtcgtttactgccttcctctccacttttattcctggcataattttttttttttttttttgatacggagtctcggtctgtcgcccaggccggactgcagtggcccgatctcggttcactgcaagctccgcctcccgagttcacgccattctcttgcctcagcctcccgagtagctgggattacaggcgcccaccaccacgcccggctaattttttgtatttttggtagagacggggtttcaccgtgttagccaggatggtctccatctcctgacatcgtgatccacctgcctcggcctcccaaagtgctgggattacaggcgtgagccaccgcacccggcccctggcataagtttgaatgatttcaacatccatgtgggtggaccatccaatgctcttgcctctcagttccttggtcccatctcttctagagatcttttccctattctacttcagccttgcacttgtgtggtcataccttaagcctgggctcacaaactcaaatgccagtagggtaaggcccttactaccaatgagtgaagaaggccagatgttagtcagcagaaaatagtggaagctgtgacctccctgcctggtgctacagttctcttttagaaaggagtgaccgccactcagctgcagccagctgtcatgtggaaatgctagaccaggatttccacatcttccaattcatggaaacacaggttgtcatgtgctatctcccaaattttacatattggcaataatatggactttcagtctaaatattgtgacattaaaaaacatttcccctcttaaaaatcagctcaaaagaagaaaaaaaaaagggaaaattaaattatatcttccttgaaacgtggagatattccagaagttagaaaacagtgaagatttggccggacgcagtggctcacgcctgtaatcccagcactttgggaggccgaggtgggcggatcacgaggtcaggagatcgagaccatcctggctaacacggtgaaaccccgtctctactaaaatacaaaaacaaaattagctggacgcggtggcgggcgcctgtagtcccagctactcgggaggctgaggagagagaatggcgtgaactcgggaggcggagcttgcagtgagccgagatcgcgccactgccctccagtctgggcgacagagcgagactctgtctcaaataaaaaaaagaaaagaaaacagtgaagatatggtaagtgacttagcagaagggaggggaccaacctcagtgactatccagggcaatgccatgaagaaacaagctcattgcattgcagaagcacggaaatattcaggaatgaattggaggctccaggtaccacaaaagatagatgggaatggaaggaggtggcaggcactgaaaataggagattgatctaaaatgtggaataggaaacacttattaccccggtatcctctctcatttcagcggaaatggaagtatattctcaggagaagaactagagagtggcattaggtacaatagactgaaaagaaaaggttacaggaaagttgtatatggagtgatgagatgctaagctcctttctgccacccagatgcagaatgctagcaacctcagacaagagatttacgtatcttcccatgtagaccgttacaattttttgttaaatccatagatttcattgttgtgactgtttaaacattgtttagtaccgaacctagtattgtcccgtgattatattttcctgccttatacaatttcttattttacctggagttaataattgccttgttttcaacttgttgttttcctaaaactcatgactaagtgttcccacatccgcaagagtaatgtcaaatgcctgcaatacagttttccacacactcaaaccagacagagagtctacccatttcagtttttcttggactcagccctctgaagccctccatcctgctgctcctatctgtacagatgtgctctccgggtttctgcccagttcagagagagagagagagagagagagagaggaaagagagagagagagagagaggaaagagagagagagaataagaaagagctgtttattttaaggaattggcacatgtgattatcctctctgtacagatgtgctctccggggcttgtgcccagttcagagagagagagaaagagagagagagaggaaagggggaggggggagagagagagaagaaagagagagagagaggaaagagagagagagagaataagaaagctgtttattttaagtaattggtgcatgtgatcatggaggcttgcgaaatacaaaacatgcagggtagctggcaggctggagacccagagaaaagttgtagtttgagtccaaaggcagtcggttggtgtcagaaattttcttgctcagaagacgttagtagttttattctattaaggtcttcaactgattggataaggcccacccacattatggatggtagtctgctttactcaaaatccaccaattaaatgttaatcacatctaaaaattgtcttcacagaaacatccagaataatgtttgatccaccaggtaggtttgagaaacaaggaatgaagagtaaagaaagtggtaaatatgtggatgaatctaagcaaatactgataaaaaaataataataacaatgtcttaatgggttaaaaagaataattaaaatacatagaataatagttcataagttgggaattaagtaaaaagaattaaagttttttttttttttttgtggtggggacaggttttcactcttgttgcccaggctggagtgcaatggcgtgatctcggctcattgcaacctcagcctcctgggtcaagtgattctcctgcctcagcctcccaagtagctgggattataggtacccaccacccctcccagctaatttttttgtatttttagtagagatagggtttcaccatgttgagcaggctggtcttgaaattctgacctcagctgatccacccgcctcggcatcccaaagagctgggattacaggtgtgagccaccacacccggtctagtgttctttcttttattatgaggagaaagttaaaggatctgttaactttagacttgattatattaagtgagcatattataatttctaaggcaactactaaaagaaatgaacaatgcatagcttttgaactatttaaaggggaaaacattgaaatgattaaaatactcagtatatcaaaaataaagtaaaaaaggagaaaagaaaaaacatggaatgggtgtgtcaaatagaaagcggtggctcacacctgtaatcccagcactttgggaggctgagatgggtggatcatgaggtcaggagatcaagaccatcctggctaacatggtgaaaccccatctctactaaaaatacaaaaaattagccaggtgtggtggtgtgtgcctgtaatcccagctactcgggaggctgaggcaggagaattgtttgatcccaggaggcagaggctgcagtgagccaagattgcgccactgcactccagcctgggcgacagagcaagactctgtatcaaaaaaaaaaaaaaaaaaaaaagcacaaaatatgtttgcagatttaaactcaaatatatataaaatgtgagttgtgcctttaggaatggtgcaatgtcatggccttaacaatgtagtgttaattacatttcatgtaaataaactaaacgctccagttaaaagattttcagacttgataaagacaaattctatctccatgttatgtacaagaaacatgttttagaattataaagatatagaaaagttaaaaggtaaaaggttatataagatataccaaaaaagcctaagccaaaggaaactagtatagctatattaagaaagatatggttttaaagaaaataaaattacaataaaaaatcagtgaagacacaaaaggtttgaataagataatatgattgacatagtgagatctccacctaactactgcagaatatatatatatcaaacatacagaaaaattattaaatacaaatgaacaaataaaagcaagtctcaatacatttcaaaggtttaaaatcatacaatgtgtgttcttagattataagacaagccagaaatcagcaaaaattcgaatgagaaaaattaatatgttagggattaaaagacaatcatgcttcaaaacaaaattgtaaaaatgttagaacatattttgaacagaattatagcaaaatattgcatataaaatttatgacataatttcaaaataagtatattcagagaatctaaaaattaattaagtaaacattcatctcaagaagttagatatgcatgagcaagaaggaaataatgaagataaaaggagaagtctttgaaatagaaagcaaatatataatagattcgacaaagccaaatgctgcttcattgattttaacaaaattaaaatatctgtcaagaagtattaaaaaaaaattagaaggcacaaatagtcaatatgtagaaacagaaaagagacacacttaggtatatttcagatatttaaaagataatacaaggttaatatgaactggaaaaatttagacaaaatggataatcttctaataaatatataacccaccaaagtttattcaggaagaaataggaaatctataataagagataggaaattttacaattatggtgcccatacaccccattttgcccaggacagtcccagtttatatctattatggattaatgtccattaattattttcataacccctttaattctcaaaagcgctccagtttggaggataagccatatggtcatcctgcctgtttataataattagagtaactaaatccgtagtcagaaatgttccgcaaatgttcctcctaaaaccattccaggcctcaattcaccaaccagttctaccaaacattcatggaagaaataatttcaatcttagccaaactctttcacaaaatagaaaaagaggaaatttttcctgactcttaagactagtgtaaccttattactaaaatgtggcaaagacagtacatgaaaagaagattacaggcaatgtcaagcacgaacacagacacaaaactcgtaatccaaatatttgcaaactgaatttagcagtatctaaagggataataaattatgaccaagttggcaatatcccaggaattcaaaattggttttatgttagaaaataaactaaaataggccgggcctggtggctaacacctgtaattccaatgctttgggaggccgagatgggaggaccacttgaagagtttgagaccaacttgggcaacataacaagattccctctttacaaaaataagaataataacaaaagctggatgcagtgtgtgtgcctatactcctagctactcaggagactgaggtgagaggactactagagcccaggagttcgaggctgcagtgagctattattgtgccactgcactccagcttgggcaacagagtgagaaactgtctctaaaaaaaaaaatcaactaaaataattcaccatgttaccacattaccacattagagaagaaaaatcataacatcttctcaatagatatggaaaaaagcatttcataaaattcagcatacattcatgatttaaaacctcttatcagagtgagaatacaaaggaacttccttgatagttatcttcaaaaatcatacagcacatctcactcttaatggtgatattaggtggagatcagggcaacacaagcttcctactatcattgcctctatttgatattgtgatggtggtcccagccaataaagtaagaaaaagattgtgtaagaactagaaaggaaggaacaaaactgccattattagtgacgaatatgcttatgtaatagaaaattttaattaaaactacatatattattattagaattaatgagagatgaacaacttttctggatatgaaaaatcaaaattgcctttctttacatcagcatcaaagcactggaaaatggaaaaaaaatatacatttacaatagtgtcaaaacatataatgtacctaggaagaaaatctaacaaaaatgttatggagaaaacaataaacctttattgagagatatcaaagaaactataatggacaaatatatagtagtccccccttgcccatagtggatacgttccaagacccccaatggatgcctgaaactgcagatagtactgaaccctatatacactgttttctcctatacacacaaacctaggattaatttgtaatttaggcacagcagagactaaaacaactaaaaataaaataaaacaattatgacaatgtgccagcattattactctttcactttagggccattattaaataagataaggattccttcaacacaagcactgcaatactgcgacagtcggtattgaaaactgagatggctgctaagtgactgatggatggggggcttgtatagccgtgggtgctctgggcaaagggatgactcatattctgggctatgcagagcaggacagtatgagatttcatcccccccagtcagaacggtgcacggtttaaaacttatgaattgtttatttctggtgaattttccatttaatattttgggactgtgactgaccaaaagtaacagaaactttggaagcaaaatagtggataaggggagactactgtaacaagtttctggattagaagattcaatattgtaagcatatcagaattttccaaatcaacccatagattcagtgcaaacacaccaaacacataatcgtttaagttattgagcttggcaaactgattctgacgttaaaatggactgatagctgataatttttttttttttttttgagacagagtctcaccctgtggcccaggctggagtgcagtggtgcgatcttggctcattgcaacctccgcctcctgggttcaagcaattctcctgcctcagcctcccgagtagctgggactacaggcatgcgccaccatgcctgctaatttttgtatttttagtggagacggggtttcaccatgttggccaggatggtctcaaactcctgacctcaagtgatccgcccgcctcggcctcccaaagttctcaggcgagagccaccatgcccgaccagctgagactttttttttttttttttttaagacacagtcttgctctgtcatccaggctggagtgcagtggcgcgatcttggctcactgcatgctctgcctcccgggttcatgccattctcctgcctcagcctcccaagtagctgggactacaggcgcccgccactacgcccggctaattttttgtgtttttagtagggacggggtttcaccgtgttagccaggatggtctcgatctcctgacctcgggatccgcccgtcttggcctcccaaagtgttgggattacaggcgtgagccactgcgcccggagctgagacattcttaaggaagaaaagcaaggtggaaataaatatttgtcctgtacgatgttgagacttaatacatcactagaatgattaagaaggtataaggttggctcagggatagacaaatagacccgtagtacagagagagagccccaaaatacacctagacacatatggatacttgatatacaacagagttggcattgccaataagtcatgaaacgatggctttttcatgaaaggtgctgagacaattgggatttcttataaaagaataaaacccaaaatggtcctataccttacattacactaaaaaatcatttataggtaaattatatgtgaaaagcaaacctgtaatgcttttagaggataatatagcagatatctttaagacttgggaatatggaactatttcttaaatattacattaaagcatctagccataaagtagaagattaataaataaggcaatattaaaactaagagcttctatcatcaaaagacacaagactgggagaatatattcacaatatatataattggtgaaagattaatctccgaatatatatatttatatagtttttaaaatgcctacttatcattgagaataaggcagacaactcagtagaaacatgcacacaggggccgggtgcggtggctcacgcccccagcactttgggaagctgaggagagcggatcacgagttcaggagttcaagaccagcccggctaacacggtgaaaccccgtctgtactaaaaatacaaaaaaattagccgggcgtggtgtcacgcccctgtagtcccagctactccggaggctgaggcaggagaatcgcttggaccaggaggcgaaggttgcagtaagccgagatgcgccactgcatttcagcctggtgacagagcgagactctgtctcaaaaaaaaaaaaaaaaaaaaagaacgaaagaaagaaaaaaagaaacatgcacataggagttgaatagacaactcaacaaagaggcattccagatgtctgataaacatatgaaaggtgtcatcttcatttgcattcacggaaatgcaccttgaaacaacagcgagataccctacaatcccaacaggctggctaaaattacgaaatctaaaataagtttgggaactcaaaagcattgctagtgtgagcacaaattggcaaaacaactttggaaaacagcatgacattatggcatagttgtcaacgtattgcttctcagctcaaattcacttttcaatacaagctttgagatgagggaatttctttaagcatttctcctctaaagtgagcacgatgttgagctttctcagtagagggcgctaggcaggtgttgcgggagggaggggcgcttctgcagtttctggcggaggctcagtggtcaaccgtgcgggtgggaaggggtcgggtggattctgcccttccatatgcccagagttccaagtccctcagcgacttcacagcccccttgtctgctcaacacggtcactatgtgtttcaggcgccctcaggcctgttgcacagtcacacgcaggccaccagctgcggctcccctgcccagcctgcactttggagggttgtttcctgttttttttttccaccactgcaaaccatcaaatttctctgccatccagtgggttcaactacaccttctccaacgaagtcagaaccacagttttggagagggagccccttgcaagtttattcttccttgggtaactctctcttggccccaaggcaccatgaaagttttcttattttctatagctactcctttatcccaacttaataattctttatattaaactctccctttgcggtaggagtttatattaaactaaaccctttgtgtttaaaataattgcgtggtttctatcttctgattggatccaccctgctaagtattgagaatgtgccatacaattccacagcaattccacttctaattatcttttctagaggagatttttgcacacgtgcattaattcacaggaaccaaaacgtttatagcagcaatttgcataaaagccaaattctgaaaataactcaaatgttcatgaagagagaacagataattaaattgttacagtcctacaaggaaatgaaaatcagtgaactacagctagacagaacaaaatggatgaatgtcacagacaatgttcagtgtgaaagaagcaggttacaggttggtgtttactatataatcccattgatcccatttaaagttcaactttatttaaaactaaactacattgtttggagatatatatatattaaaaccataaagaaaagcaaggaaatgaatattttaaaagttagaatagtggctacctttataaggttgcttttggggtgccctctttgtcatgcggatgtggttacataggtatttgaattacaattcctctttgacttatgcatatatgttctgtgcattctattaaagtctttgcaattatgtaaactaataaccacaacacaaagaaagacacagttcctgcctttatgaaacttacggggagaaagaacaaaacagaaaacgtggaatcacttaagatggagatagcatgattacattttctttctttctttctctctctttctctctctctctccttccttccttccttcttttcttttttgagacaaggtcttgctctgtcacccagggtgggatacagtggcacgatcatggttcactgcatctttgacctcctgggctcaagtgatgctcccacctcagcctcccgagtagctgggacaacaggggtgtaccaccacacctggctaatttttgtattttttgtagagatggggttttgtcatgttgcccaggctggtctcaaactcctgggctcaagggatccacctgcctcagcctcctaaagtgctgagattacaggcatgagccactgtgcctggcctgcgattcattttttaaacaagtatctttggactgcaatccggctagattagaccttggaacaatgaaatatgacaaacattttaaaaatgcattgttcagctggcaagaaagtatggtgaattccaagggtggaaaacaaagagataatcaacaagcagagatatggggagctgatgctgtagttgccttaggtgcagtagtgatgtactggtctcagtagccaggcagcttggattttaatggtcacctgctgtccaggacaggctttgggcctaagggagatgggaaggttgaagtgagaccctggataaagctataccacagggacatgatagactagaaaaaaaattacggacacagggagacaaaataaagcttttgtgttttggtttgcactccagttagaataaaatcaggggtgtaatcccagcactttgggaggctgaggtgggcagatcacctgaggtcaggagttcgagaccagcctggcaaacacgacaaaaactcatctctaataaaagtacaaaaaaattagccaggcatggtggtgtgtgcctgtaatcccagctgtccaggatgctgaggcaagagaatcacttgaaccctggaggtggaggttgcggtaagccaacattgcaccattgcattccagcctaggtgacagagtgggactccatctcaaaaaaaaaaaaaagaaagaaagaaagaaagaaaaaagaaaagaataaaatgcagggaaaaatgtgcccagagaagattgataatcttgataatccagggttggacctcatgttggtctgatattctaaattacattacccatgtgagccagtaatctctaggtagaaacattaacataagaattaatcactctaggatgatactactgctgggcacctggcagaagcaacataaaaccgctttagagaaatacacctgtacccaggtcacatggaacgtccaccaaatgggagctcatgaacctaaattacaataacatgatgaaataattcatcctgatgaaaagtcaacagacgcaatagtcagcaagattagactctcagaactttagaaaatataataaataaatattagtaaaatatcaagattataaaaccaggagtcacataacacaagaacatcttagtatcaagaaaaaattaatttgaaaaaactagactgaacttccagaaataaaatatgtggtcaatgaaattaaatatatcttcttgcataatagttcctaaggcattggcctcaaagtagtctttacaggaaattggagctgcctagagtcataatgtcaggtgagtgataatttacaagcaattatagatatagtgatatatttagaggtgagagcagccttatagatatactagtgacactccctttggtgaaagatataaaaatcttagccccaggatgtaaaccaagtcacagataacagtaaactcccatctagagcacacatgttctgacacctgttaagtgccttttcagatatgtcacattcccctatccatagacacaggcacctgctgagagaaagatcagggaagtttgatgacacttgttgcagtgaaaagctggtaaaaggagaaaggaaagaggctatctcagacctgaaaaggctgggagactatttttgtatataataacaggaaatagtcttcacattatataaacaggaatttaatggaggagagccacccagggactctggggaatgctggaatacatacttgcttacgtcctgcgagggtggatttgagtgaggagcagggcagtgaattctggcacttgtcagtgccagggctaaattattctgctcctgtttggtggaggtaacagctcttacatcactttaattgtttccttccattgacgtgaaatgaggaatttcttccatggagtgcttggttcaagcactgccaagagttggcaaagctcctagtggcatctttcacttttggtctctggtggctcttaaatacagatgaattgtgtaggaaacaaacaggaggaattatcaatcatatgtgtctcctctcaagaaaatgtgccattttcctcttatatatactgcgatggcatttgttttttcaagtttgctcagttcacaatctgcacacttcaccttcttcaagaagtctcctaggctgaaagctattgtcagctgttctgtgattctatcttgtgttaccattgcaggtgtacatgtcttacctccttcagtagacagtgacttcggaagacagatcctggtctgatccatttttgagttctctataatggctttcccagttcctcacacacatttggtgcttaataaatgtttgtcttatgagtgaaccgatctttgatttgttgtgtagtaaacatacaaaattctaggctgtatcagctagaaattatgttggtactagtgactgagaacctagcatagtggcttaaataaattaaagccttctttttctgtgatgtaaaaaaaaaattattagtcttgtcagtccaggatgggtaaggcagcttcaccacatcatgagggacccaagcacttccttccattctgcgttcttcagcatgttgcttgcatcttcgaggtcacaaaatatctgccagagctccagccagtaggtctgcattttaggagaatagaaagggaaagacaaggggcaagcaggctcttccctcattggcatgaaaaaaccccagtaaagagagttgcaggaaacaccaatcaaagacttatatttaaatttcattgaccagccccttaactgcaagggaggatggggagtaaagctttttagcttggcacactttccccctaagcaaaatctgagttatgtttctaaggcacaaagagagagaggatattgggtaagcagcctgcagtctttgccatgaaggatcttaatcattcatcagtaagtatgatcttttttttttttaaatgtcaattgtttctttaagatttttagtttctcttcaaagtctataggtaaatcactgaaatttatccagatcccagccttcacatccagggattttggtgtaccaccatctactcaatgctccccgtcctcctaccccatcaaatgagcttcgtttgtttttcctttatctctaagtggtatgacaccatctgctgttttctgcttttgacccagagccatgtctggcatcatcagactaatcaagaggtgggaagggacaaggtcaggcatgggttagtgacacaaaccacttggtaattaaaaaccccttggtgataacattttctccttgcacaacaaaatatccattgcaggattttgataaaattctgctctattaatcatcagcaattggaagctcagaatgtgaggctaattgtcagattgatgttgcggctgagaggaagtattaaaatttcgcaaagaccataagagaggcagttatagaaatagtgtgctaattcttagcttacatttccatatatgttaaatttctcttagaaattatttggattactgatgtacaagtgattactaaagataataattaatcaatttagtcctccattccattaatcaataattgttgagtatatactatttgccaggcattgtgctagctgcgagagctataaatgagagttttttaaatgtagacgtttctgagttaaagatacactgaaaggctaaaatgaacagcaggaaaatgagatgataatctgaaatcagcttccatagaccaataatcccagaaaggctgcgagaaaattaatagcagaaactaagcttgggtattttgcaattctcttttagccacacaaaattaaattagaaattctgagaagactcaagcagggactgttaatatggggttttgacatgtattaactagacaatctttatgaataaagaaaagagaacaagtcgcttccatggcataatattaaaataaggcctcctggatagccactattctgaataagataagaaagacgatgccattacagctaagcagctcaaaattccattagaatattttaagcgttagtataggaatttacacaagagttagagaaaatgaaatttaaaaccaagacctgaaaggcactcatgaatttaagggcaggtcattttgcaggggttgggtggggcaggagaatcactggattgtgaaattgaaattgaaattgaaattggttaatttcaacggactacttgatacaattgatagccatggatttggcaactgtggatgccagggcagacagagtttgctcctaagaagatgcccaactcagagacgctgggtcctgtgtcccatggtctccagtgcctttcatttggagatcatatcactgtcctgtgcttttgaccttgttagttggtctgacatacttgttttcttccctttagctgaatgaataatttataatctctggaaagtataaaaacccaatgtactcttatgtaatttgtgtttaaatgtaaccattatgatgtcctgtgcatactatgttaatgttttaaatgatttttgaaaggcttaaaaagatttctctctacaaaatttataaggctgatgtagtagattgttaagaggaaggtttcttacatttgtaactctccctttgtatatttcgaatgtttgagagggggagttatattaaaataaaactttcaaatagccaagggaatttgattggttaaatatgcaaatgatgtttaacatgaaacattactcctggccaggtgcggtggctcacacctgtaatcccagcactttgggaggctgaggcgggtggatcacaaggtcaggagattgagaccatcctgactaacacggtgaaaccccgtctctactaaaaatgcaaaaaattagccaggcgtggtgacgggcacctgtagtcccagctactcgggaggctgaggcaggagaatggcgtgaacccaggaggcggaggttgcagtgagccgagatcgcgccactgcactccagcctgggcgacagaatgagactccgtctcaaaaaaacaaaaaaaagaaacatcactcctgtaatcccagcactttgggaggccaaggttggcggatcacctgaggtcaagagttcgagaccggcctggccaacatagtgaaaccccatctctactaaaaatacaaaaattagctgggcttggtggcgcaagactgtaatcccaggcactcgggaggctgtggcagaagaatcgcttgaacctgggaggcagagtttgcagttagctgagatagcgccattgtactgcagcctgggcaacaagaatgaaactccacctcaaaaaaaaaacacaaaaagttaatgattatactttaaaaaaaattttactgaagtatgaattttatcaggttaaaaagagccttagctctagatttaagagcataattgctgggtcatatgtgtatggctccagcttggatggaaagttctgaattgttctccaacactcccactgcaaccccaccacacattattccatagtctgccaacacttgatggtgtgaggctctctgcttgttcccaacctgacgactataaaatgatatctcgaccaggcgcggtggctcatgcctgtaatcccagcactttggaaggccgaggtgggtggatcacctgaggtcaggagttcgcgaccagcctggccaacatggcaaaaccccgtctctactaaaaatacaaaaattagccaggcatggtggttcattcctgtaatctgagctacttgagggggctgaggcaggagaattgcttgaacctgggaggcggaggttgcagtgagctgagatcacgccactgcactctagcctgggcaacagagcaagactccatctaaaacaaaaaataaataaataaaatgatatcttatgatggttttaacttgacttttcctgattattagtgaaatttccatttgtcttttatgataatttttatgttgtctttttcttatacatatatattctggattagtcccttaggagagttagatgtgttgcaaatagcttctcctagtttatgcagattttttacttttcttttttttttttagtatgtcttttgatcagtagaagttttatattttaatctcgttcagtttattagtcttctcctttatagttggtgcttaggttttgaaatatcaagtaccttttggtaatttttcaacagcttagcttatatggcacaatgcatttcatatgtacatatacaaatgtcaaaattataaatatgcctaaattatacatctgtaactagccttaaatattgtaattaaaactgtataattaaactaagcatgcaagccaatagtttaaaaaagagtttcactccagtttggtactgatttagctcttgagctattgaaatcaatggccagcatatgaagcaattatctgacgcttgtgggtggtgaccttgcagcagctcagcctcttctttcatttcatcctatttttgtccttaatagcagatatttatctcagtttaaaattttattattttctttataactacaatcttaacagtttaaaatagtactaaatttcatgtggaaagaaacttcagattctcagcaccttatcttccttagcgatttccactctagccctcaatgttattaggtaaactcttatctcaattgttgttttcactgagtgctatctaaccataatgaaaaagggaaaaaaaatagagtccgaattatccataactgcctctgctttctgagaaaggcaacgtgattctttttcagtggaggaaaaacctctctatggacttttttcaccccataacagagagattagtgggagaaagagaagagcttgagattcctgtctatcagggcctttggaaattcaaattgtgtcccagagctgaattctccaaaagaatgtacagagatttggaggtgcgggggagagagggctaaatagtttggcgggaggctggaagctgagctggtagatagggtcagaagactttttaagaacaaagactggagacttgaggtgactccatcttcactattacttcagatctttcttataatgtgcttcataaacacacaccttgtgtgaaagctgcttttgagaaaaagaaacgtattttatgcgacgcagggtgcaacaggagcggcgcatgtggggcagtgagaaattccttcccctgacccgattcagcagtgaaggtgatcagagcaaataggaactggactgcttcacgctcctcaaggactttaaggagtgtgtcttccaccacccacagcaaagggctcagaaaattttatctgaacctcctgacatctgagttatacaaactaagacaaagaatgggaagcacatagcagccactggtccattacagttctaaagtccagccaggcgcgtatttacccgagatagaaaatgttccttagtcagggtctagtactgctcactggaagtaattccccgatccactctttttttgaggctctttagttcatcctctgtgctcttggctctgccctccaagttgtccttcattttcattagaagtagctttcacaatctgctgcttgcccctaaaaactggggacccagagagttcatttcattttgaaataatgtccctgctccatttagttagagctggctttagcaagtatgcagcaggggactaatatccagaatttagaaggaattcaaatgactcaacgacaacaacaaaccaataattccattaaaaagtgggcaaaggacatgaatagacatttttactttcttttttgtttgtttgcttttgagacagagtctcactctgtcacccaggctggagtgcagtcgggtgatcttggctcactgcaacctctgcctcccggactcaagcaattctcctgcctcagcctcccatgtagctgggaccagaggtgtgtgccaccacgcttggctaatttttgtattttcttcttagttagagatggggttccgctgtattggccaggctgatctcgaactcctagttaagtggtccacccgcctcggcctaaagtgctgggattacaggagtgagccatcgtggccggccaaatagacatttttcaaaagaagacacacaaatgaccaacaagcatatgaaaacatgcttaacatcactagttatcagagaaatgcaaattaaaaccaaatgagatatcatcttacaccaatcaaaatggctattattattattattttgagatggagtcttgctctgttgcccaggctggagtgcaatggtgcaatctcagctcactgcaacccacgcctccccggttcaagcaaatcccctccttcagcctccctagtagctgagattacaggagtgccccaccacgcctggctaatttttgtatttttagtagagacggggtttcaccatgctggccaggctggtcttgaactcctgaccttgtgatccaccagcctcggcctcccaaagtgctaggattacaggtgtgagccatggcgcccagcccagaatggctattattaaaaagacaaaaagtggcagatgttggtgaggatgtggagaaaagggaatggcttacacattgctggcagaaatgttaattagtacaacctctatggaaaacatcatggagatttctcaaagaaataaaaatagaactacaattcgatccagcagtttcgctactgggtatctacacagagtaaagaaatcattttataaaaaaagatacctgtactcatgtatatcacagcactcttcacaatagcatagatatcagcctaagtgtccatcaacaaatgataggtaaaagaaaatatttgtctatatacacaatggaatgctattcagccataaaaaagaatgaaatgatgtcttttgcagcaacgtggatggaactggaggctatgatcttaagtgaaacaactcagaaacagaaagtcaagtactgcatgttttctctcataagtgggagctaaccggtgggtaaacatggatattgagtatggatgatagacagtggagattaggaagggtggtgagatagggagagagaatgataaatcacttggtggtacaacctatgttatttgggtgatgggtaacctaaaagctccgactccaccactacacaatgtattcatctaacaaaattgtaccacataaatatatacacattttaaaaatttaaaaaaaagttctgagttcttgttgagtcttattgaggatcacaccatagcagaaggactacatccataattctttctaagatgcgcttttctgtactttgggccacatgtgaggctgctatggtaaatgctcttaagattcttagaagtccaactgtctagttgagaaagtctactaggtgctgccttaaatcttatagaagttttaataagggatcttggctgggcacagtggctcacacctgtgatcccaacactttgggaggccgaggcgggtggatcacctgaggtcaggggttcgaaaccagcctggccaacatggcgaaaccccgtgtctactaaaaatacaaaaattagctgggcatggtggcacatgcctataatcccaggactcaggaaactgaggcaggagaatcgcttgaacccaggaggcaaagttttcagtgagccaagttcatgccactgcactccagcctgggcaacagagtgagactccatctcaaaaaaaaaaaaaaaaaagatgggcattttaccttattaaaatagtaatcataagggagcttatagacaaaccttttttttaatgtttacttaccttggccatttcttactttgagaatgttttgctggccggagatgctgtcctgggccctctgtttcttcttactgctgcctaaaacctaaagagttctttctttccattcatctctttcttcctgcactttatcttcctgcactttactaaaacctaaagagttctttctttccattcatctctttcttcctgcactttatcttcctgcactttactaaaacctaaagagttctttctttccattcatctctttcttcctgcactttatcttcctgcactttactaaaacctaaagagttctttctttccattcatctctttcttcctgcactttattctgcactttcttcctgcactttgtaactttcttcctgcacttcatcactttcttcctgcacttcctgcactctccattcatctctttcttcctgcacttttaacacaggtaaaagaagccaattgtactttcaatattttacctaaaaatctccttattcagatcaagttcattagctatattttatttctgtctttcatgacattacaggtgacaatgtggccaaaaatctcactactatgtaacatcttttgtcacgcttccaaaagcaattttctcactgctattgcaggcttcctaacaatttcctcactgcccttctagcctctgctgcctcccaatatcagagccaatgacaaatgttttagggtttggttatggcagtatcccacttccagatagcaatttctgtttcaattatctactgctgtgtcataaacccgcccagcatttagtggcttaaatcaatatccattttattgctcacaattctgtgggtcaggaatttgggtgagggctgatggcaacagctcatctcagctccagtggggctaactgggaaagatccaagctgtcggccggctcgggcaccttgattctcctgtctgtggcctctcatcatccagaccctgttcctttccatgtagcgtctccaacaggacacgctggacttctttacacaccagctggcttccaagaaggcagaaacagaaactgctaggcctcttatggcctaggcccagaagtcacaatgccacttccagagctttctgttggttagatcaagtcatgaagccaatctatattcaagggaaggggaaagatatttcatttctttgctgggaatgatacatcacaaaacagcatgcaggataggatggattggggtgaccatttttagaaaggacctacctctcagaaagaggcaaaaattcatgaactgaaatactctctgagacaatctctattttatagtctagcaataaaccagaagttcaagctctgctctctggctatgtaagcaaactgaggtcagaaaggagttcaagcaacaacgaattgatacaaggctgctgttacaagattctcatctatagtggtttggtctttgctcgagcattttgagagacaaactgcctccaaaggagacctgttccacaattgaataattctaaagtctataacaatcttccatttgcaaagttcaacattgcctttctgtgactcctcccatggtcagatatctgccctccaaggccactgaaagaaaggctactccctcctcaatatggcattcatttaaatctaaatattttcagacacttttcttgactcaagacttcctaacttctttacctgtctatcatgttaagtcattatttcccagaaacatgtgtttatgtataacacatacaatccatagaataaaatttgcccagaatagtatgtttaagaggaaagaaaagtatgtaatagattattgaaagtttcaaaatatctggtggtacaatgagtgagttaaacatttatctggcttaaccattcagtttgatcttgtggaaatccagtgcttggaacttatcttgtcctaactttttcataacatagtcactgtttacctgaataattgtctaaatgtagtgtcctttatggttggttagtattcactgggtgatggggaaaagaaatacataaatcctgagaaaagctgaaagcaaagtttattcttacaaatgacaaaaaatgcccagatacaacagactctctgtttgatgtgtgtgtgccagaatgaaaactatgggtctgaggcaccttctttttaaaaaaaaaaaaatttttatttgcataggtttttggggaacaagtgatatttgagtacatgagtaaattctttagtggtgatttgtgagcttttggtgcacccatcatctgagcagtatatactgcgcccagcgtgtagtcttttatccctcaccccctttccacactttgtccctgagtccccaaagtccaatgtatcattcttatgcctttgcatcctgaggcaccttcttccataagcaccatccagaaggagaagtggttcttcaactatggctgatgggagcaaagtgctgaagcaactatgactggttgaaagaccatttctcctgtgaatggtgcttatggaagaaggtgccttagacccaaaactagagtgaggcttttattggttggggaaggtggctataaaaagataagaataatgaaaagctatgaccaattaaaaaaaatgagaacttaatcacagccttatcgacccacaaccaggggtccacaaatagccttaattatgacttatgttattaagataacaaccccaaattttccgggcagcaattttttggtgccaatattttggtcttttgcttccaaagactagccttttgataaagtcagacagctctaaaatgtatgtgtttaagttctataaatagacatacatttgaggatatatgaaaggagcaaagtatttatctcaccacacagttaagaattttaaaaacattcattgttggatagtgatttttaaaacattaaaataagtggaacgattgctttgaatttatgaagaataacacatataattaatgacttttctatttgtattatacttgcttagatggttcaggcttagtaagaaagctattgatagtagaaaacaatgtgtatatgtaataataaagaaataacgtggattgttagtgaatagaaaatagtccttttggccaggtgtggtggcttatgcctgtaatcccagtactttggaaggccaaggcaggaggatcacttgagccaagcagttcgagaccagtctggttagcatagtgataccctgtctctacacaaaattaaagtaaaaaaattatctgggggtggtggcgcacacctgtggtcccagctacttgggaggctgaagtgggaggatcccttgagcccaagaggttgaggctgtagtgagccttgattgtaccactgcactccagcctgggtaacagagtgaaatcctgtctcagaaagaaagaatgaaaaaaagaaagaaagagagagagagagagagaaagaaagaaaggaaagaaagaaagaaagaaagaaagaaagggaaagaaagagagagagagaaggagggagggaaggagggaaggaaggaaggaaagaaagaaggaaggaagggaggaagggaggaagggaggaagggagggagggaggagggaaggaaggaagaaagaaagaagtggatatgttttggatgtttatcccctccaaatctcatgttgaactgtaatcccccatactggaggtgggacctggtgggatgtgttggatcgtgggagcagatccctcgtgaatgacttagtgccatccccttgataatgagtgagttcttgttcagttggttcacgtgagatctggttgtttaaaagagtctgggacctcccccttctctctctctctcactctctctctcaccgcgtgaccctgcgtgccctgatttaaagcttcctgaggcctcaccagaagctgagcagatgctggtgctgtgcttgtacagcctgcagaaactgaaccaaaaaaacctcttttctttagaaattacccaccctcaggtattcctttatagcaatgaaaatggcctaacacaatagtcttttgactatatttagtttgaagatagttccagatatttccctacattactttctcatctttagtgagcaaatggtatactgaaactagatagtgatggtggtgcgacaatgtgcgtgtactaaatgtctctggattgtacacttaaaatggttaaagtggtaaattttatgttatgtatattttaccaccacaacaaaaaaaacctttcttttttttttttttctttttttttttatttgagatggagtcttgctctgtcgcccaggctggagtgcagtggcacgatctcagctcactgcaacctttgcctcccaggttcaagtgattctcctgccttagcctccccagtacctgggattacaggcacacaccaccatgcccggtttatttttgtatttttttagtagagtcggggtttcaccatgttggccaggctagtcttgaactcctgaccttatgatctgcccgcctctgcctcccaaagtgctgggattacaggtgtgagccaccacacctgaccaaaaataacctttcaaaacaaacaaaccaacaaaaaacacccatagttcacctaaatatgcctgaaaatgtactttgcagggaacctaaaatctgggatttgaagtaaaaaaggataaccccaagttgaatttgttaagattgcccaccttttctttgctgacaactggcaaatggtttgctaacttctgggcagatgagagttcagtcagcacaatcaacaaagaagtgacgttcactcgggcccaggcaggcctatgtgctgggagcttttggaccttaaattggtctgagttcactgttgctccagttgcagacaggagcaggcaggttcaagagtttctgatgctttgctgtccagcagtcagctgaccatgagcacagccggcacaagcagccctttatgctggtgagaatcctgccagcagtgctgaggcacaatccctcctttatgtgttccctttgcacatttgtattcttggggcctttgggatttttgttgctgcagataatgggaaatgggtgtcggtgggtgttacgagcagggttttcagtagactaggaagaacaactggttaaaaataaaataacaatagtgacaaataggaaaggtgggcaacctcaggcagtacagctcctgagcaaatgcttccagcttttaccctaaaacataagcaactgggcacaactccaggccttgactgtctcattggctgataggaataactactaggaactattaagattacctgatattctggccttttcataattacagtgcagcctagttgatgttgttggaacatgatggttctttgatagaaaagtctctactttcattacaaatggaaagtgcaaatcagaagggtttgtaccatttggggttaggatccaaaacatttgttccaccaagggggaaaaggtccaactacaacaagttatcttgagattgtccagggtgttctctaaagccctaaatccaaaacttttccttttttgaggcagactctcactctgttacccaggctggagtgcagtggttccatctcggctcactgcagcctccgcctcccaggttcaggtgattcccctgcctcagcctcccgagcagctgggattacagacgtgtgccaccacgcctggctaattttttgtatttttattagagacgcggtttcaccatgttgtccaggctagtctcgaactcctgatctcaagtgatctgctggtcttggcctcccaaagtgttgggattccaggcgtgagccatcatgcatggcccctgcatctgaaactttaatgtgcatgcggattcaaatggggatcttgtcaaaatacagtttctgattttgaagattttgcatttcttttttttatttttatttttattttattttttatctttgagatggagtctcgctctgtcgcccaggctggagtgcagtggaacaatcttggctcactgcaagctctgcctcctgggttcacgccattctcctgcctcagcctcccaagtagctgggactacaggcgcccgccaccacatctggctaattttgtgtatttttagtagagacggggttttacagtgttagccaggatggtctcgatctcctgacatcgtgatccgcccgccttggcctcccaaagtgctgggattacaggcgtgaaccaccacgcccggccgaaaattttgcatttctaacaaggtttcagggagtactgatgctgcaggtctgaggaccacacttcaagttgcaaggctgtcaggaagtgagagctagctagggggaaactagcatcatttcagttaggtctagtattgctgctaatttactgaaagttttaaaatgtagcttttctgtaaagaaacaaacaggacattctaactaaacaaagtgctgtgaaatcagtcattcacactgggtagctagagctactgtgtctcaactggaggaggcaccatctccagtggatcatttagaaacgtagagggtggctactggtatttggtgcctgggggcccagggcactaaatgtctggtaatgtgtggaagagttctgcacaaataattgtcccactcaaaacgccaagagagcccccctgccccgccccattcaggtacccgagctacaccagtggagatggaggctgcacccatacctgagacctcagccaatcaattctatggccatctccttgagtgtgtcatctggaatagaagatcctgcccatgtattgtagctcatctctttagaactttgactgcccttggaattctccagtgggaagagtggcctctgtctagtgtaccacatgtggttccatagcttgatgtattctctcagcaaaggatgagatcgacaggaaaggcttcaggaagccctacggaatttggattcatcaacattttgaatcaaaaatcagaaaagggaacatccagtgttccccttgagacgataccctcaagtgctgctggtgctcacctcctaaactcctaaacggggctgtgaccagcttgcctagtgccaacgacaacagctccaaggcatctgggcctatcaaacttccactgcgttcttttccacaaaagaaagaatcccacagcgctagatttgctggccatcatgtcaaacaaactctgacctctgatcccaacacagtgttgaacattacaatgaggatgttagaaattctgctggagactgagttgaggtaaaaatagatacaggggctgggcatggtggctcacacctgtaatcccagcgtgttgggaggctgaggtggaaggattacttgaggccaggagtttaagaccagcctgggcagcatagcaagaccctgtctctaaaaaaaaaaaatttttttttttaattagctgtgtgtgtttccacgtgcctgtaatcccaactactcgagaggctgaggcgggaggattgcttggtcccagaagttggaggagtgcaatgagctgtgatcccgccactgcactccagcttggtcaacagagcaagaccacatctctaaaaacaaagacacagatatgagaaataaaatagggatgaaaggaatgagttaagacaatgttagagaaggatgacgtagtaagaaacctgaagataacgaaaacccacattaacctaatgttgcagaaaagagggcttcatcattgttgtctgagaaacttgtgagtaaaagacaaaaataatacatattgtgagaaatacattcaatacaatataaggaaaatattctttagcttcttgagactccatgaagttcaagagttaggaaattctgaaaagggtttggcagggtcatagtgattccgtctggaaagggtttgtttgtgcttggtctcagggctgctaggaagatgggaaatgtctctggcactccaggagagcaattactctgtgccatgacttcatgtgccccctcaccatgatgcagtgccccatgggagatgttctgtcactgatcccactgtctcactacattccaacagtccaaaagacaggcaaaaatttagactgataactttttttattagtctgatttaaaaattagttacacaagtaaaataatgtctgtatcacactcataatcacgtgtgcacatgaaaatgttagctcagaggaggttgaatgcttctccagtgcagacttcctggaaagctggaaagctgggcaatggctcaggggcccctgggcacagcactgtcttctcctgaatgagaatcagctgtgctgatgcctacgttagttcaagaaccaggagctgcataaacaagcttttgagaagtatgccagaagaagctcagattgatgatggtgtgtttgacaaaattaatgaagccatgcttattagactgaaagataagattccaaatgtgagaatacaggcagttctggcgctttcacgacttcaggatccaaaggatgatgaatgcccagtggttaatgcatatgctactttgatcgaaaatgattgatttgaatccagaacttagacaggcagtgttatcatgtattgcaccatcagcaaagactttgccaaaaattgtagggtgcaccaaggatgtgaaagaggctgtcagaaagctggcttatccggtgttagctgaaaaggttcgtatgagagctatgtccattgctcagacagtaatgctccctcaacaaggttttaatgagagatgagatgctgtgaaacaagctatgtggaagcatcttctccaaagctggttatggttctctgagggaaatatcttcgagtggcttcagcagttggatgtagaaaattctgaagtggcagtctctgtcctcaatgccatgttttcaatgactcctctcagtgaactggtggcaatctgtaaaaacaatgatggcaggtacataaaggattcattctttgaaatgtaatactgattaacttctacaattaatttgttttttttcctccccatagcttaagattatattaatatctttaatcttacctcccttttgttttcttttagtctgatgaatatcttctttcccttcttttttcccctcctggtgtaagaactcattactttatcttagactatctactttagctgtggttttctacccctcggtttcttactttgatttttgaattagcctaccatgagaaaatccagcaacatgcacccctagtatatgtttgcttatttggttcttttttgttctaagttccttcattcctttctgtgttaatgactctaattaaaaggatagtggttttaaagcaaatcttcttattcttatttatgttctcttcaatttgtaatgatataaagatcatgctttctcttacactctttcttttaagtgaaggaaattgattctagtggaaacgttaactcctgaaattgctttgtattggtgtgccctttgtgaatatttgaaatcaaaaggagatgaaggtgaagaatttttagagcggatttcgccagagcctgtagtatatatagactatttactgaggtaaatttttttttcttttagtttggagaatgcttgtgttgctgcaactgttaacctcccagcccccttcctcgaggtcatgcttgattgtgaatatgttaaaaatcctttttttttttttgtacatgccgggatagttatatacattgagtctttttgaatatcttgtatatcttgtgctggtctgtataatgaaagagcaaatcatgtttaggatcatttcttcaaaactattaagatatgattatgaacatttctgcatatacagttgataatgatgatgtattatttctgaaattggttggcacattttctgttaagtgccagataataagtatcttagggtcttgtgggccataccatctgtcaaaaacaaaaacaaaaaacaaaaaagaccaggagctggttggacatttgtgaatgttctcttgccctacttcgactctcacttctcttaagttctgtacctcgactacacaaatcagaggctgccagcagatggatgtgtgcacgtgtgtgtatgaatgtacttcctgtccacctggaacttacctgcaaaaatccttgccacaatttggatgtgcagagaaagtgttgtttcttattttctttatatcctttcttgccttcctcaggtactacctattaccagcaggaaaacaaagcaaacaaaccaacagaacccaggaaaatggaaatggcccacctgatttaagctttagacatacacaatactttattgtacataagtgtcaaatgaaattaaaaacgaggaaaaaaagacatacacaagactttaaatggctccgtgggcactgtccagccctcagcttggatccgtctggctatccttgtatgtggtggcattgctttgggtgtcagggacgcccttggctgcttggcttctggactccctgcttacttatgagctcaggcctggggctggggggttcatggtgggacccgtgggcacaggaaccactcttgtggggcatagcccccaatggacccagattagacccctctaagtgcctgtagtgccatccatgcaaccacctccagccctgcctcagcctgacctcgctctagcaccatggacttggggcccacccagcggctctcagccacccctttcatgctgggactttgtgagggacactcagcacctacatcaggctgatcgcctcgccagactcttcctgctctttttttatccaccacgctgtagactgccgaggtagacttttctttacatttcctctgtgacatcttccccctaccacttcagagaaagccctgaggcccagcaggtccagcagatggatggaaggactctcttcatctccactgtaagaaatggtttaagctgcaaggcatacctagaccattcaaatagcagctgaaagaatccaccaaatccacaaagcacggatttcaagcctagcctcttgacaagagagaacatacctgctctcggccccaggcaataaaccccttgacttgattttgagatgaaagaggctagaaggaaatgtggcataaggacaaaaggcactggttaaatatttgtagactattctttccattaccactgttctatagagtcttgaggagaaaacaagacaaagcaacaaataattatataattcagtagctgcaatagataaagagaaccattaaaagaataggttttctcaattataaaatgaggcattaaccaaattttgaatattaactatatatttgactattcctggacaactagaaggctggcgattgtacatgcatttgtatttgccagttgtgtgtcttcctcctttcaacctcacacagctaatttatgttgaccctcaaaaaagaaaatgagtacttgaatgtcaaggcatgtgactttcattctaggacatatagtaacttccagagcactgagtcagcagtctaaaggtttagccttcatactcctgacagctgtttatttctttcagtgtaatttcagagaaacatatccagaagggatttgctgccctagatctatcagaaaacatatttaagatattctgtagttttatagcacaaaaatctaacactaaataatcacatcataacagggtttcaatttctgtaataatttatcttaaatcaggcacaagggtatttaaagcacacaactaatactttgtagagatttaatgagatgatgtatgggagcagtaggggctgagacatttgtttccagtactattttaaagcaataagagaataatagcatttgaaataacctttccaatctattggattcaggcttctgccttctgtatctaaaaagaagcttagtcactggcttctggtagatgagtaggacttctcaaagatcaggaaggcttggggtcatagctggtgatgcataaagggccccaggtcaagaagtctaagcccatcaggctcagattgaaaccaggaacctgagcgacaggccaaattgggacttaggaggtcctctaggcaaaatcagtccctgaaaaggaagattggagcagaaaccagtggctccagcaggtgggagagagcagacagcagttttcatccacaaggtaactggttgctttgatagcagctctgcctccctaagtgcttcagatatgaagcaactcctaagaaaagaactagaattaaaactatcaaaaattacaagaattaaaataatagagtagaaagtatctatttattacaaaagaaagcaatgaaaaggaatagtcacgagactaacaaaatgaagtcatgagcatgacaaataaatattgaaatggcagatataatttcaaccatacaaataataacattaaatgtgaatggattagacaccccaatcaaacgacagagattgttaagactggatttttttttttttttttgagatggaatcttgctctgtcgcccaggctggagtgcagtggtgcgatctcggctcactgccagctctgcctcccgagttcaagcaattctctgcctcagcctcctgagtagctgggattataggcgccccaccaccacgcccggctaatcttttgtatttttagtagagacagagtttcaccatcttggccaggctggtcttgaactcctgacctcgtgatccacccgcctcggccccccaaagtgctgggattaccggcgtgagccaccgcgtctggccaaggctggattttttaaaacaagacccacctagcagggtgtggtggctcacgcctgtcatcctagcactttggaaggccgaggcgggtggattgcctgagctcaggacttcgagaccagcctgggcaacacggtgaaaccccatctctaataaaatacaaaaaattagcccggcatggcggcgggcgcctgtagttccagctacttgggaggctgaggcaggagaatcacttgaaccctagaggtggaagttgcagtgagctaggatcgcaccactgcactccaggctgggcgacagagcaaggctctgtctccaaaaaaaaaaaaaggccgggtgtggtggctcacgcctgtagttccagcactttgcgaggccaaagagggtggatcacgaggtcaggagatcgagaccatcctggctaacacggtgaaaccccgtctctactaaaaaaattagccgggtgtggtggcgggcgcctgtggtcccagctactctggaggctgaggcaggagaatggcgtgaacccgggaggcggagcttgcagtgagcccagatggagccactgcacttcggcctggatgacagagcaagactccgtctcaaaaaaaaaaaaaaaaaaatcaaaaaacaagacccacctagtatgtgctctttaaaagagacgtgactttgattcaaagagtttcgagataaaaggatggtaaagatatctcatgcaagcattaactttgggagagccaaagtggctgtactaatatcagagaaaatttaaacacaaaggaattacttaatttaaaaaaaatttaagtgcatagtttagattaggaaatcaatctttgtggtgcgcagtactatgggttttggcaagtgcatagtgtcatgtatccaccattacagtactgtacacagtcgttttaccatgccccaaatgccttctggtacaactattcattcttcccgttccccagtccctgagcttctggcaaccactgatctttttcactgtctatgattttgcgttttccagactgtcaaacagtattgttgccttttcagactggcttcttttacttagcaatatacatttaaggttccttcatgttttcgtaatagctattgacagctcatttatctttatcactgaataatattccattatatgaatataccacagtttttatccattcacttgttgaaggacatcttggttgtttccaagttttggcaattatgaataaagctgctataaacatttgtgtgcaggttttggtgtaggcatatgttttcagttcatttgggtaaataccaagtagcatgatggctggatcatatggtaagagtatgttagcgtttgtaagaaactgtcaaactgtcttccaaaatagctgtaccattttacattcccaccagcaacgaaagagagttcccattgttccacatacttgctatcatttgatgttgttagtgttttggattttgggcattctaataggtgtgtagtggtagctcattgttgttttaatttgcagttgtcttatgacatattatgtcgagcatcttttcattgcttatttgctgtctgtatatcttcttaggtgaggcgtctgtttagatcttttgtctatttaaaaattaggttgttcattttcttattgttgagttttaagagttctttgtatattttagatacagtcctttattcaatatgtcttttgtaaatattttatcccagtttctcattctcttgacagtgtctttcacagagtagaagtttgtaattttagtgaagtccagtttattaatttgttccttcatggatcatgcctttgtgttctaaccaaagagttattaccattccgaaggtcacctaggtctgctcctaagttttgcattttacatttaggcctatgattcactttggggtaatttttgtgaaggatataaagtccgtgtctagatgcacttttttttgcatttggatgtgtagttgttaagcaccttttgttaaaaagatggcccggtgtggtggctcacacctgtaatcccagcactttgggaggccgaggtgggcagatcacaaggtcaggagttcgagaccagcctggccaatatggtgaaaccccatctctattaaaaatacgaaaattagctgggtgtggtggtgcatgcctgtaatcccagctactggggaggctgaggcaggaggatggcttgaacccaggaggcagaggttgcagtgactgagatcgcaccactgcactgcagtctgggtgacagagcgagactctgtctcaagagaaaaaaaaaagagagagagagagaaagagaggacattggggcctataggcacaggccaccatgcctggctaatttttgtattttttgcagagatgaggtgtcgccatgttgtccaggctggtctcaaacttctaggctcaagtgacttgcctgcctcggcctcccaaagtgctaggattacaggtgtgagccaccacacccagactgttgagaatttttgtgtttatgtctgtgaaaaacattggtgtgtgattttgattttttgtaatgcctgtgtctggtttttatactagggttatgctggccacatggaatgatttaggaactattccctctgtttctattttctagaagagattgtaatgaattggtatatttattccttaaatgtttgatagaattcactaacgaacccatctgggcttggcgcttactgatttgaaggttatttgttgttgttgtttttccaactttgttgagatataattggcattaaaaaaactgcatatggcctggcatgagggctcatgcctgtaatcccagcaatttgggaggccgaggcaggaggattgcttgaggcttggagtttgtgaccagtgtgggtagcatagtgagatcctgtctttattaaaaaaatttcaagataaattagctgggtgtgatggcacgcgcctgtagtcccagctactgaggagattgaggcaggaagattgcttgagaccaggcatttgaggctgcagtaagctatgatcaaaccactgcagtccagcctaggtgacagagagagacactgtctctaaaaacaaaaaaatccaaaacaaaaatctcccccaaaaaactgcatataaatttatgcatacaatttgatgattctggacatatgtatatattcatgttgctattgctgtaatccaggtaatacacgtatctgcaactttccccgtgtcccctcttttttttcttcataagaacacttaacatgagatctaccctgttaacaattgtttttacgacacaatatcttgttgttagctatggacagtctattgtacagcagatctctggaactcaccgatcttgtttaactataactttatacccactggataacaactccttttttctccttcatgccatccccaggtaaccctcgttctgttgtctaattcaacacctttgactattttagatgctcatattagaggaatcattagtatttctctctctgtgactgaattatttcacttagcgtcatgtcttccgggtccttccacgttgtgacaaatggtaagatttccttctttttaaaggttgagtaacgttgtgttgtatgtctatgtcacattttctttatccattcagctgtctatgaacatttgggttgtttctacatcttggctattgtaaataatgctgcagtgaacacaggaatgcataaatattttctcccattctgcggggttgcttttcaccccgcggattgtctcctttgctgtgaaaaagctgtttagtttgatgtaatcaaacttttctatttttgcttttgttgcttgtgcttttgatgtcatatccaagaagattattgccctgaacaatgtccaaaagcttttccttgggtttattctagtagttttacagtttcaggtcttacgtttaaatctttaatctattttgagttgattctcatatatggtgtgagataaggtccaatttcattattctgcatgttgctattcacttttcctggtaccacttattgaggagactatctttttctgcattgtgggttcttggcacacttgtcaaagatcagttgaccatagatgtgtggatttatttctaggctctctattctgttccattggtctgtctgcctgatttttattccagtacaacactgattactgtagctttataatatattttgaaatcagtaagtacgatgcctccagctgtgttcttcttgcttaatattgcttcagctatttgggatttcttgtggttctatattttttgagatttttttcctctttctgtaaaaaaatgtttaccgtattttgatagggcttgcactgaatctgtagattgctttgagtagtatggacatcttaccaatattaagtcttctaatccatgaacaagagatgtcttcccatttatttgtatctgtcttaatttctttaatcattgcttcatagatttcagtgtgcagtctttcacctctttggttagggttattcctaatattttatctttttggtgccattataattaggattgtcttctttttttaatatactagttggccacatagatatcttcttttgagaaatgtctattcatgtcctttgccaattttttaacggagttttttgttttctgcctaatttaagttccctacagaatctggatattagacctttcccagatgcataatttgcaaatattttctcccactatttactctgttgatagtttcttttgctgcaggatgctctttagtttaattaggtccccatttgtctatttttggttttgtttcaattgcttttggcatctttgtcatgaaatcttagccagggcctatgtccacaatggtatatctcaggttttcttccagggattttatatttttaggtttttcattcaaatttttaattcatcttgagttgatttttgtgtatggtgaaaggaaggagtccagtttcaatcttttgcctatgcctaaccagttatcccagcatcatttattgaatagggagtcctttccctattacttgtttttgctaattttgttaaagatcagacggttgtagctgtgccgctttatctctgggtcctttgttctgctctttttttcttcgagtctatttttgtaccagtatcatggtgttttggtttctacaaccttgtagtaaagtgtgaagtcaggtaataggatgcctccagctttgttctttttgcttaggattgctttggctattcgggctcattttggttccatatgagtttttaaatagttttgtataattctgtgaataatgtcattggtagtttgataggaatagcattgagtctgcaaattgctttgggcaatatgacaattttgacaatatttattcttcctatccttgagcatggcatgtttttctatttgtttgtgtcatctctgatttctttcagcaattattcagtaattcagtaattattattgtagagacctttcacctctgtggttagctgtattctgaggtattttactttttgtgtgtctattgtaaatggcattgcattcttgatttggtgttactggtgtaaagaaatgctactgatatttatacattgattttatatccttaaactttggtgaagtagtttatcagttctgggagctttggggcgaagactatggggtttgctaagtataaaatcatattgtttgcaaggagagatggtttgactacctcttttgctgtatggatgctttttatttctttctcttgcctgattgctctggctaggaatttcagtactatgttgaataggagtggtgggagtgggcatccttgtctcgttctggttcccaaggggaaggcttgcagctttggcccattcagtatgatgttggctgtgggtttgtcatagacagctcttactattttgaggtatgttccttcaatgcctagtttgttgagggcttttaacatgaagggaggtttaattttgtcaaaagacttttctgcatctattgagatgatcatgtggtttttgtctttagttctgtttatgtaatgaattacatttattgatttgtgtatgttgaaccaaacttgcatcccagggataaagcctactttatagtgctggatttgttttttgatgtgctgctgaattcagtttaccattattttattgagggattttgcatctatgttcatcagggatattggcctgaagtttcccctttttgttgtgcctccaccaggttttggtatcggaatgatgccagcttcatagaatgagctaaggaggtgtctctcctcctcaattttttggaatagttttagtagaattggtaccagctcttctttatacatctggtagaatctttctggcccaggaccctctctggttggtaggctttttattactgattcagtttcagaacttgttactgatctgttctggttttaatttcttctggattaaatcttgggaagttgtttccgagaaatttatccatttttctaggttttctagtttgtgtggtaatgtcccctttgtcatttctgactgtgtttatttggatcttttctcttctttcctttattagtttaggctagtggtctatcgatcttatttattcttgcaaaaaaaccaacttttggtatcgttgaccttttgtgtgttttattgtgtctcaatttctttcagtttggctttgatttttgttttcttttcttctgctagctttacggttagtttgctcttgtttttctagttcctctaggtgtgttaagttgttcatttgaggtctttctaactttttgatgtgggcacttagcactataaagtttcttcttcacactgcattagctgtttcccagagattctagtatgttgtatctctgtcttcattcgtttccaagaatttcttgatttctgccttaatttcattgtttacccaaagtcattcaggagtagattgtttaatttccatgtaattgtatagttttgagcaatcttctaagtattgatttctatttttattgtgctgtggtctgagagtgtggttggtatgattttgtgttttatgaatttgttgagcattgttttatggtcgagcgtgtggttggtttttcagtatgtgccacctgcagatgagaagaatgtaatgtatagtctgttgttggctggagtgttccgtagatgtctgttaggcccatttggtcaagtgtcgagttcaggtcttgaaaatctttgtcagttttctgccttgatgatctaatactgtcagtggagtgttgaagtcttccactatttttgtgaggttatctaacaaaataggtctctaagagcttgttttatgaatccagtgctccagtgttggatgcatgtgtatttaggatagtaaagtcttgtggaaattaaaccctttatcattaagtaatgcctatctttgtcttattttattgttattgatttaaaatctgtgttgtctaaaattagaaaaggaacccctgctcttttttctttccatttacttggtaggtttttctctatccctttactttaagcctatgggtctcattgcatgtgaggtggatcctctgaagacagcataaagttaggtcttgtttctttatccattttgccactctgtgtcttttaagtggaggatttagcctatttacattcaaggttaatattgatatgtgcgatttgatcctgctgttgtgttgttagctggttgattgtatagttgttttatagcatcaatggtctatgtacttaagtgtgtttttgtggtggccagtaacagtgtttcatttccatgtttcgcactcccttaagggcctcttgtaaggcaggtctggtggcaatgaattcccttagcatttgcttgtctacaaaggatcttatttctccttcactcatgaagcttagtctggctggatatgaaattcttcgttggaacttcttttctttaagaatgccaaatataggaccccaatctcttctggcttaagggtttctgctgaaaggcccactgtcaacctgatggggttccctttgcaggtgtcctgccccttttctctagctgcttttaatattttttctttcatattgatcttggagaatctgttgactatgtgatttggggatgattgacttgtatactatctcacaggaattctgtgcatttcctgaattctaatgttaacctttctagtgagttttgggaattttttaaaaatttatttaagttctcagatacatgtggagaacgtgcagatttgttacataggtacgcatgtgccatggtagtttgctgcacctatcaacccctcatctaagttttaggccccgcatgcattaggtatttctcctaatgctctctctcctcttccccgccgcccccgacaggtcccggtgtgtgatgctcccttccctctgtccatgtgttctcattgttcaactcccatttatgagtgagaacatgcagtgtttggttttctgttcctgtgctagtttgctgagaatgatggtttccagctgcatgcatgtacctgcaaaggacatgaactcattcttcttcatggctgcatgatagtccatggtgtgtatgtgccagattttctttatccagtctatcattgatgggcatttgggttggttccatgtctttgcaattgtaaatagtgctgcaataaacatacgtgtgcatgtgtctttatagtagaatgatttatattcctttgggtaaatatccagtaatgtgactgctgggtcaaatggtatttctcgttctagatcctcatggaattgccacactgtcttccacagtggttgaactaatttacactctcaccaacagtgcaaaaggtttcctatttctccacatcctctccagcatctgttgtttcctgaatttttaataatcaccattctaactggcatgagatggtatctcattgtggcatcaaatttgatggtatcaaaaagatttgcatcaaaacttgatgatagcaaaagatttgcatttctctaatgactagtgatgatgagtttttttcatatgtttgttagctgcataaatgtcttcttctttagagaactgtctgtacatatcctttgcttactttttgatgggattgtttgtttttttcttatacatttgtttaaattccttgtagattctgggtattggacctttgtcagatgggtagtttgcaaaaattttctcccattctgtaggttgcctgttcactctgatgatagtttctttcactgtgcagaaactctttagtttgattagatcccatttgtcaattttggcttttgtgcaattgcttttggtgttttagtcatgaagtctttgcccatgcctatgtcctgaatggtattgcctaggttttcttctagggtttttatggtttggggttttacatttaagtctttaatccatcttgagttaatttttgtataagttgtaagaatttgcatatgttgaaccagccttgcatcccagggatgaagctgacttgattgtggtggataagatttttgatgtgctgttggatttttttgccagtgttttattaaggattttctcattgatgttcatcagggatattggcctgaaattttgttttttttgttgtgtttctgacagcgtttggtatcaggatgatgctggcctcataaaataagttaggaggattccctcttttttgattgtttggaatagtttcagaaggaatggtactagctcctctttgtacctctggtagaattcggcagtgaatccatctcctgggctttttttggttggtaggctattaagtactgcttcaatttcagaacttgttattggtttattcagggattcgacttcttcctggtttagtcttgggagggtgtatgtgtccaggaatttatccatttcttctagattttctagtttatttgtgtagaagtgtttatagtattctctgatgatagtttgtatttttgtgggatcagtagtgatatcctctttatcattttttattgtgtctatttgacacaataaaatttatagataaatccatgaagatgagggaaaaacagcacaaaaaagctgaaaattccaaaaaccagaatgcctcttctcctccaaatgactgcaactcctctccaacaagggcacaaaactggatggagaatgacattgatgaattgacagaagtaggcttcagaaggtgggtaataacaaacacctctgagctaaaggagcatgttctaacccaatgcaaggaagctgagaaccttgacaaaaggctacaggaactgctaactagaatagccagtttagagaggaggataaatgacctgatggagccgaaaaacacagcacaagaacttcatgaagcatacacaaatatcaatagccaaattgatcaagcagaagaaaggattcagaaatcaaagatcaacttagtgaaatagtcatgaagacaagattagagaatgaagaatgaaaaggaatgaacaaagcctccaagaaatatgggacaatgtgaaaagaccgaatagactagtattgattgggggtccctgaaagtgatggggagaatggaaccacattggaaaacacacttcaggagaacttacccaacctagcaagacaggccaacatttaaattcaggaaatacagagaagtattgaggatactcctcaagaagtgcaaccccaagacacataatcatcaggttctccaaggttcaaactaaggaaaaaatgttaagggcagccagaaagaaaggtcaagttacctacaaagttaagcccatcagactaacagtggatctttctgcagaaaccctacaagccagaaaagagtgggggccaatattcaacactcttaaagaaaagaattttcaacccagcatttaatttaatagtcagccaaactaagcttcataagtgaaggagaaataaaatcctttacagacaagcaaatgctgagggattttgtcaccaccaggcctgccttacaagagctcctgaaggaagcactaaatatagaaaggaaaaactagtaccagccactgcaaaaacacaccaaatataaaaccaatgacactatgaagaaactgcatcaactaatgtgtgaaataaccagctagcatcataatgacaggatcaaatgcacacataacaatattaaccttaaatgtaaatgggctaaatgtcccaattaaaagacacagactggcaagctggataaagagtcaagacccatcggtgtgctgtattcaggagacccatttcacatgcaaagacacgcataggttcaaaataaagggatgggggaatatttaccaagcaaatggaaaggaaaaaaaaagcaggggttgcaatcctagtctctgataaaacagactttaaaccaaccaagataaaaaaagacaaagaagggcattacataatggtaaaaggatcaatgcaacaagaagagcttactatcctaaatatatgtgtgctcaatataggagcacccagattcataaaacaagttcctaaagacctataaagagacttagacccccaaatagtaatagtgggagactttaacaccccactgtcaatattagacagatcaatgagacagaaaattaacaaggatattcaggacttgaactcagatctggaccaagcagacctaatcaacatctacagaactctccaccccaaatcaacagagtataaattttctcagctgcacataacatgttttctaaaatcgactacataattggaagtaaaacactcctcagcaaatgcaaaagaatggaaatcataacaaacagtctctcataccacaatgcaatcaaattagaattcagaattaagaaactcactcaaaatggcacaactacatggaaattgaacaacctgctcctgaatgactactgggtaaataattaagttaagggagaagtaaagaagttctttgaaaccaatgggaacaaagagacaaagtaccagaatctctgggacacagctaaagcagtattaagagagaaatttataccactaaatgcccacaagagaaagctggaaagatctaaaactgacaccctaacatcacaattaaaagaactagagaggcaagagcaaacaaattcaaaagctagcaaaagacaagaaataactaagatcagagcagagctaaagaaatagagacatgaaaaacccttcaaaaaatcaattactccaggagctgattttttgaaaagattaacaaaatagatggaccactagctagactaataaagaagaaaagagagaaaaatcaagtagacacaataaaaaaatgatagtctttaatctttgaggctgatgacctttggatggggtttctgtgtgcagcttctttttgttgatgttgatgttgttgctttctgattgttagtttttctcttctaacaggcccctcttctgcaggtctgctgcagtttgctggaggtctactccagaccctgtttgcctgggtatcaccagtggaggctgcagaacagcaaagattgctgcctgctccttcctctggaagcttcgtcccagaggggcaccagcctgatgccagccggagctctcctgtatgtggtgtctgtcagcctctactgggaggtgtctcccagtcagaatacacaggggtcagggacccacttgaggaggcagtctgttctttagtagagcttgagcactgtgctgggagaatcctccttgtcaggatctgctgctctcatcagagccagcaggcaggaacgtttaagtccactgaagctgtgcccctgacagccgccccttcccccaggtgctctgtaccagggagatgggagctttatctatagccccctggctggggctgctgcctttctttcagagatgccctgcccagtgaggaggaatctagagaagcagtctggccacagctgctttgccatactgtggtgagttctgcccagtccaaacttcctggcctccttagcactgtcaggggaaaactgcctactcaaacctcagtaatggtggatgccccaccctctaccaagctcaatcatcccaggtcaacttcagactgctgtgctggcagcaagaatttcaagccagtggttcttagcttgctggggtccgtgggggtgggagctgctgagcaagacctcttggcttcctagcttcaggcccctttctggaggagtgaacggttctgtctctctggggttccaggcaccactggggtatggaaaacaacaacaacaaaaaaactcctgcagctagctctgtgtctgccctaacaaccatccagttttgtgcttgaaacccagggccctggtagtgtaggcacatgagggaatctcctgttctgtggattgcaaagaccgtgggaaaagcatagtacctgggctggatagcacagtccctcacagcttcccttggctggggagggaggtccccggctgcttgcacttcctgggggaggtgatgccccaccctgattctgctcaccctctgtgggctgcacccactgcctaaacagtctcaatgagatgaagtgggtacctcagctattcctattcagccatcttgccaaatctctctattatcttttataggaaaaaactttctgaagatgacatcagactcaagaagccaagtaggaaaagactgataaatctgaagatgtaaaaattaagatcctttactcagaaaaagaaaagtacaataaaaaaataaaaaataatttgagcaaaatatttgtgatacatgatgaacaatggttaagtgttcctagtaaacaaagaagtcatcaatctgaaacaatcaacagcagtaaaaaataggataagcatctcacggaaaaaagaaatactaagagcaaataaacacatgaaaacatgcacaacctcattctgaggaaatgaaaaacagaactaatggctgactacaagatttaaaaactggtgatacacaatgttgatgaggatgtgtaaaacagtcactcccatggatcattcattggaaaatatatcagagtaatcctgttggaggacaattttgcaatatctacacttagtaatttattgttctcaccaaagtacatggaggtgtattatggcttgagtatatggaggctgtagagccctcggagtatggagcccgatgccagggatcagataatagctcagcaacttctgaggtatgtgactgtggcaagctaagagccttacctgggaagtggagataagtatgtttttacctcaaaatgctggtgtgaggatctgatatatttatacactttagagaaatgcttggcactttggaacattaatctaaagaaaacatccaactgctcacgagtagagtgctaagaaggaagagcttggcctcatagttggatggctgccacgttccctgaaagtgaatgaagcaaacctctctctgactgggaggctgatgtctttacttcattaagtcctggggcatctcatgttccaggatagcatcactttccacgtttcttcctttttcatgcataagaattttagctagcggagagtaaggcaagtgaccatttcaaagacaggcattttactaaatggtggccactgaaagcttgattcctgtgctgttttctggtactttttgtcttaaagcaggatttctcaacactggcactattgacattttgggctggataattctttgttgagggggctgtgctgtccattgtaggatgtttagcagcattcctgatcttgatccactaaatgccccaagttctgacaaccaaaagtgttttcagatattgtcaaatgtcccttgggagtgaaatcacccttggttgaggatcactgggttttagaggtttggaatgaaaaaaaaaaatgattctcccgttggaagcagagactgtagttcagattatgaaccagttagatgatttcccttcttaagcatgaattcagactgcattgcctttgaaaattaatgtttggggtgtgtgtgtgtgtgtgtgtgtgtgtgtgtgtgtgtgtgtaaatattacggttaacagttatccactgggccctaggatgaataaggaagcatagcttcaccttattctcgacaaagtccttaagagggtccagattatgttccatcacactttcatgcttctgaattccacttaaaaaaaatagacttattggccaggtgcggtggctcacacctataatcccagcactttgggaggccaaggtgggcagatcacaaggtcaggagttcgagaccagcctggctaatatggtgaaaccccatctctactacaaatacaaaaattagctagtcggggcggtaatcccagctactcgggaggctgacgcaggagaatagcttgaacccaggaggcggaggttgcagtgagccgagattgcatcactgcactccagcctgggtgacagagcaagactccatctcaaaaaaaaaaattgacttattaattattttgaattagcaatatattcccatggttcaaaattgaagcaatataaatgagtgtagagtgaaaagtttctctctcatccctgtctccagatatctgggtcctgcccatgagaaagccacatgaacaggttctttgtttatccttccaaatatattttttgcatacacaaatatgtatatttgtatttataacatatttgtatatttcccttgtatatttgtatatttccctatctcatcccccccttttttaacaaaaacaggtcatacactgaacatacatgtgttcacccagactcttctatgtgcatatgttatctcttcaccactgcttcctttctaagagaactccgattttgtgcagttcttcagcaccataccctttcccctacctacccacaaacacacttcatggaatccatgtgactcaggggaagtggattccacccccagatctgggagtagctggtcaaagggtgacccattctctttgccagaggtcagttcagaaaggggcatgaaacccaactcaggccaatggacatgctgagaattttgctgggctttccagggaatttttttttttctcctgagagagctgtggaagaagtctcttttgcctcctctggacaccactatggggagaagtaaagatggggcagacacttgagggatggcccggaagaaactggagcgcctggattaagccaatcctgaagtctgcacgactgctgtcctttcaggcagaggaaagatgggtgatgtcactattagcagtctagggtgaggtgacaagtcagtgaagccatttcaaatccaagtctggtgtggcttgaaggcttttggtttacaacggtaaaatcagttctccgatgtgtagcattttacagtacaaacggtgctcccacattcaggtttcattgagagtaaatacgccaggcaaggcctctgtgcccactgcacagatgaggaaaaggagacatggaggggaaagtcttgtttaaggacacatatcctgtaagaggcagaactggaatccaaccccaagtttgtttctgttaccgaaacaccgggagtttggtctgggtcctgcggctcacagaacagaaagccaatgactgagacgatgagtattgccaaggacgaaggctttagtcgggttctgcagcagaggagatgggaactcagtctcaaatgcatctccctgactaactaaaactaggggtttatatggcagggaagcaatgtaaccgtgtgtaagaaaacgggaactagggaggggcaaggaagcaatcatggtgaatgaggggtcccacatcttattgtctgatgtgacggtctggtgaatttcagttctttggtactttttttgagatctgaagctcctttcctgaggaaggaactcggataaaacaaatataagtttcaagctttaagactagaagggtgaatttctatgtttatcaaaagaaaaaaaaactgtctatgggacaattgcattggttttatttaaacatcaaggttattttctcccaaaccaccagatactctggctggaggcattcatacccacagatgcatgccaagtgttgactctaccctcaggagcagcaggaccaggaagctctgggaggtcaggacacaggagagaggcaggaagagcccccgcaggacctactgtggtggccgagactgctacagccatatgacctccgactgtgcccagttccttttagcatgtcctcaagagtcagtgcctcggagcaaatgggctgacctctggactacactggggaagagagaaaaggaggtcctccctgttgcccaatggaagattcctcaagatggagattgagctgctcttctagggcaccccaagggcaaatgtccccatcgtctctaaggctccagccagctccaaacactctgggtggtaaatagactgaatcccctttagtgacctctctcactggcaatgttttttttctcttttttcttacaatagttgaattgatcaaaaaagaactcaatctcaaaggtgagagtagagttgatgatggggtcagggagctgacctcaatcgaaagttgagaagaaaagcatgtgtgaataacaacatccttggtttagaatttacttacaaagcttcagctgagcttatgaatgtgtcatttggatatttgctgggcttcgcacacaccccttcagtttctacacagggccaggcatatcacaatggtgtggttgcattttgtttttaatgttaggttcattttttatagatcctaaaacacaaaacgggattcgggagtgtgaatttacttgaaccaaactgaaaaaaggttttctcaacctctgcaaaatgaagctgcagaattcacaacagttttaattataacacactaaatagatacaataagtggctctttgctctgacgttgaaatctctacctatttttatctccaggcaaataacaggcggctggggaaagttactacattatgagtgggttattgaatctctgagcatcaacaacctctatgtcattacactgcattgtatgctaaagaaaatcattgtatccaggctgggcacagtggctcatgcctataatcgcaatattttgggagactgaggtgagcagatcacctgaggtcaggagttcaagaccagcctggccaacatggtgaaaccctgtctttactgaaaaaaaaaaaaaaaatacaaaaattagccaggcatggtggcgcacacctgtaatcccagctactccagaggctgagacaggagaatcgcttgaagccgggaggtggaggtggtagtgagctaagatcgtgccattgcagtccagcctgggcaacaagaatgaaactccatctaaaaaagaaagaaagaaaaaaaaaaaaaagcaaaacaaagaaaatcattgtattcaaaaataccaagatgagcaaaaatatttcaagatttcttagaagaaatttgcttcccataggcaaaggaaaactaagcacattaaaactactgctctaaagtaactttaaagcataattctccccttgagtttcaggaaagacctggaaagaggggcaagactttccctttctcaccttgccatgacctccagggccttgtagctcaggctttgaaaatgaaggtcaccataattactattacaacccagatctggaggaaggtggagaaccttgaacagagcccaccagaagtggctggctggggtcccagtgggctgcagggccagggaaggccctgcggttgctgccccacctgcctgctcttggcctcacttctttgcttctcctctggaagattctatcagaattgctttgtgctcaggaatgggcctatgatgaagagtctggctcactttttcctctgtactttgggattacatcatggaacccaatatcctgagcaagcataagaaagggaggggaaagtggatgaatctgatgtaagaagaaaacagacactcatattttcactcaattttcaaagcaatccacactacagatgaggaaactgagatttatggacgtgaagagacttgctgaaaaccacagtttggtggctgaagctggtttgaattttattctaacacaaatctttatttattttagacagggtctcactctattccttaggctggagtgcaatggcgtgatcatggctcattaaaacctcttcctccagggctcaagccatcttcccacctcagcctcctaagtagttggaaccacaggcatgcaccaccacccctggctaatttttgtatttcttgtacagatgaagttttaccatattgcccaggctggttgtgaactcctgagctcaagtgatccacctgccttggcctcccaaagtgctgggatgacaggtgtgagccactgcacctggcctcaaatatttttactgtattttattttttatttttgttggtacatagtaggtgtatatatatatggggtacatgagatattctgatacaggcatgcaatccataataatcacatcagggaacatgacatagccattatgtcaagcatttatcattgctttgtggtacaaaaattccaataatactactttagatatttttatatgtacaataaatgattgttaactatagtcaccctgttgtgctatcaaatatgcgatcttattaattctatctaaccatatttttgtagctattaaccatcttccctctcctccttcccagcctctggtaaccatcattctactatctccatgaatttaattgttttaatttttagctcccacaaatgagtgagagcaggtcaagtttgtctttctgtgcctggcttgtttcatttaacataatgacctccagtttcatccacagtgttgcaaatgacagaatctcactcttttttatggctgaatagagtactccactgtgtatgtgtacgacattttctttatccatttgtctgttgatggacacttaggttgcttccaaatcttggctattgtgaataacacttcaataaatgagaatgcagatatatcttcaatatactgatttcctttctttggggtatatactggcagtgggattgctggatcatatggtagttctgtttttagtcttttttgaggaacctccatacttttccccatagtggctgtattaatttacattcccaccaactaactcaaatctgtaaattataccatgaggatgtctaaatcaagggggcgatttttgcagtttctacaagaaaatcattgagtagttcacctaacttgattggcaaattcagtcaaatgactgtacaagttttatataaatgtagtctcatgttaaacatttaaatcatgtgttaccataaacaattattaaatcacttgaagatgtttgagaactaaataggatatttcttcatgatatatgctttaaaaagttttaattgcggtaaaatacacatgacaaaactttaccattttaacaattttaagtgtacagttctctagtgttaagtatatccacattaatgggtaaccagtctctaggacttatctcataaaactgaaactatacctattaaacaacaacccctcattttcccttctccccagcttctggcaaacacaattccaccttctgtttctatagctgactactctagagaggtcatatgaatgggatcattcggtatttgtccttttggattggcgtatttcacttagcataatgtccttaaggttcatccacgttgtagcacgtgtcagaattgtcctcctttttaaggctgaataatattccgttgtatgcatagaccacattttgcttagccattcttctgtcgatagacaggtgagttgttgccatcttttggcgattgtgaacattgctgctatgaacatgattgtacaaatatctctttgcaatcttttcaattatttggttatatacccagaagtggagttgctgtatcatatggtaattctgtatttaattttttaagaagctgccatagcgttgttcaaaactgctgcaccattttacattgccaacaacagggcacaaaaaattgaatttctctgcattctctacaacacttgctattttctgggttttttttgcaagcagttattctaatgggtatgaggtggtatctcacggtggttttaatttgcatttctttattgatcagtgatgttgagcatctttgactatgcttgttgtacacttacatacattatttggatagctgtctgttcaagtccattgcccatttctaagctgggttatctttttgttgttgttgagttgtaggaggtcattatatattccggatactaaccctttgtcagatgtatgatttgcaaatattatctcccattccataggttgccttttcattctgttgactgtttcattctgttgacttttgtcttttgacagacaaaagtttttaattttgatataatttatctatttttacttttgttgcctgtgcttttggtgtcatagccaagaaatcattgccaaactcagtatcaagaagattttcctctatgttttcttctcaggcttatatagttttggctcttacatttgggtctttgatcgattttgtgttaatttttgtatatagtataaggaaagcatccaattcattattttttgcatgtggctatccagttttcctagcatcatttgtggaaaagactgttctccccctttgaatgatcttggcactcttgttgaaaatcatttaaccatatatgggagggagggtttatttctgggctctctattcaattccactgattcatatgtgtgtctttatgccataaaggtactatggctttgtaataaatttggaaatcaagaaatatgagacctccaactttgttattctttttcaagactgttttggctattcaagatcctttgaaataccatacgaattttaggatgaattttttttttaatttctgtgaaacatccatgagattttgacaaggattgcacaaaatgtgtagattgctctggttagtatggacttcttaactatattcagtctttaaatataagaacatgtactgtatttccatttatttgtatcttctttaatttctttcagaaacactttgtagttttcagtgtacaagtcttttgcctcttggttaattctgagtattttattctttttgattctattagaaatggaattgttttcttagtttcctcttctgactgttcattttagtgtatgataatgcaactgatttttatatgttgattttatattctgtatattctgcatctttgctgaatttgtttattagttctaatagtttgtggaatctttaggggtttctacatataagatcatgtctgtgaacagacataattttacttcttcctttctggtttggatgcctttatgattttttttttttttttttttgagacagggtcccactctgtcacctggctagagtgcaacggctcaaacacggcccacttcagctttgaacttctgggcttaagtcgtcctcccacctcagcctcccaagtagctgggactacaggcacttgccaccatgtccagttaatttttttaaaaattttttatagagatgggggtcttgctatgttgcccaggctggtcttgaactcctgggctcaagcaatctccctgccttggcctcctaaagtgttgggattacaggctgagccaccgtacctggcctatgatgcatttttattgaaagaaaaacagacaccattattttgcattacaaaatataaaacagaagaaatttcacagccaatcaaacgggagtttagaattggatcctcctgcactttcccctacacttctttcaaagctgccttcctctgcaaggcttctgcctcacctctgatcacccacaacctgagctctgagcacccacacctcacctctgagcactatgacccatctggatggagctactgcacggtcagtgtgggaacatctctgaggaagatgcattgtcttctgtggagttacctaaaaacactggggcatgttctcctaactgccttcacttagtctaaagatgaagcaattcaacaaaagtacatgtaaacctcaaaactggacttggagttttaaagatcaatggactctattgtctattgtctggatggtttgggggtttcctagctcatttttttttcttttatggtatagacacctgaaggctctttgctcagtactcctcactgtgtggctgccttccactgcagacgctgtgctgaaggttgggttctggccactctgtttacacccttttggacttgaggcttgcctgttggttccctgaaacgtggactctggatctgggtgctaaccaattccctttctttccaggccggggtcctgagacctcactgtaatgagagactgtgacctcttttctcatgtctcaggcaggctatgatgccttttctagttaaggaccgtgttgaaccaggtgaaatcgccatttttgttggctgtttttgtcctgcaaaactgacaatttcatgtccttaaatttaatacctttggagtagaaactacctattgttgtccaatagaggaaacaaagtttcttcctgaaagcatttgtctgaacaaaacagtatttgttttatctgcatttccccttcattcacttgtatcattcagggacttgcacatctcagtcacatgtgtgacgcactcacatgtatggctccaatcccatcttcacggcacagagaactaaattctctcccaccttcccgtggagagccctctgtcctcatcatcactggttcctttcttctggatccttccacctcaattatgtttctctgagggtgcaatgacaagaataaaatgaaattttgttcttgttcagttaagtaataaattgtcatttcttccattttctctttgactaaagatgtattagctttattattattttttaaatagagacaatgtctcaatatgttgcccaggctggccttgaactcctgagcttcagtgatcctctcgcctcggcctcccaaagtgctaggtttacaggtgtgagccaccacgcccggtaaaagatgtattagctttaaacaaagttaaaatttcttctcagttgtgtaaaaatcacagaagaatgcagcatgtcctctaagtgtcagcctgtgtggggctgaaaaaacagtggagtcctttgttcactgtcttaggagtctttgggatttctgttgatccacagacttgcataaagagtttgtcatgatgacagggcctctgcacatgatgtgaggatgtggaccccctttcctccccacagccagtgccggcccgactcataaaagctcaaagatccagtgagaccagcctcagtcagatcagcccatccatgagtgggggttgttgttatatatatttatgctccatctcactgccaaagagggatttggggtggattatagaaatgcatacaacaggggccgggcgcggtggctcatgcctgtaatcccagcactttgggagagccaggtgggtggatcacaaggttaggagatcaacaccatcctggctaacatggtgaaaccccatctctactaaaaatacaaaaactagctgggtgtggtggcgcgtgcctgtaatcccagctactgggaaggctgaggcaggagaattgcttgaacctgggaggtggaagttgcagtgagccgagatcacgccacagcactccagcctagtgacagagcaagactctgtctcaaaaaaaataaataaataaatagataaaaataaagaaagaaatacatacgacaaaataaaaataaaataagcaaagaagtggaggaagaagaggagaattaaggtaagaaattaagatgaagtcatttgtttctttttgcctattcatattttgagttttctcttttcttattgatttgtaggagttacttgtatattctagatctgtgctaatacgttagccaccagtcctatgtggctattgaaattaattaggctgggagtggtggctcacacctgtaatcccagcactttgggaggccaaggtaggtggatcacttgagctcaggagttcacgaccagcgtgggagacatggcaagaccccatctctactaaaaatacaaaaattagccaggtgtggtggcacacctgtaattccagctacttaggaggctgaggtgggagaatcacctgagcccaggaggtaaaggctgcagtgagctgtaatcacaccactgcactccagcctgtgtgacagagaccctatctaaaacaataataataattattattaaagttaaatagaattaaaaatttagctcctcagtcaccctcctcccatttcaagtgctcagtaaccacaactatccagtggccagcatagacctacaccatttccatcatcacagccaattctcttggatagtgttggtctgtatattaatcccttgtcaattttattcatttcaaatatcttcttcgagaaaattgttctctgctaactttgattaagatgtcttcactgaacagaaatgtttaggcttttttgagacagggtcttgctctgttgcccaggctgtagtgcagtggtacaaccatagcttactgtaaccttgaattcctgggctcaagcaatcctcttgcttcagcctcccaagtagctagaagtataggcatgcaccacaatgcctggtcaatttaaaaattttgtagagatggtgtttcactgtgttgccagtcttcctacctcagctcacgagttctcacgagatctgatggtttaaaagtgtgtggcacttccccctttgctgtctctcctgctccaccatggtaacacgtgcctgcttccccttcgttttccaccatgattgtaaatttcctgaggcctctgaaccatgcttcctgtacagcctgtaggactatgagtcaattaaatctcttttcttcataaattacctagcctcagttagttctttatagcagtgtgacaatggactaatacaccttaaatgtttagtttttatatggttgtgttcatcatattttgccctgtaatatgtgcatttggagtcttgtttaagaaatctcctccctgaggtctcagagatatttcccctcaccttttggtatctgggttgtggatttccttttcatatgtgggtagtgaatccaataggactttgcctttgctacacagcgtgaggcagggatccaaccctatgctctccatctagtgaggggttttccccatcattgctgttaacagattcatctacacatccatcgtctccccacaggtcttgtgtgccactgctttcctgtgcccatccaaggtccatgagggcaattttgggctcttgcaggctgcatccatctctttatgtttcctctgccaggaccaaattgtcttatcactctgactttgtgcaacgacttcacgcagggagagtgctctattctccctcactcttgtgttgccaaatgttcatagctcttctaggaccttgctcatctagattcactttaaaatctatctttttgagtttctcaaaatgtgtatagaaaatcagcagtcactcactaatgaaatactctcttttaagtgaaaaataatatatgtgctgtgaagctccgtgatctactttaaacctaggaatgaagttccaagtgttaacggtgatttaaaatccattccattgagtttcggtttgtctggggcatcagtaaatgctcatttccaaaagtgctttgcctttgaaggctactaatgcatgcagtgtgttgccatggcaacggttacttttagttagtactttttatagattaaagtgctacaccctggagtctattcatataaatgcataaatcttaagacagtatggtacttcatttaatgtagatatttaatggaacagagtcagacttaactgaccagaaatggaaaattttcaacacttatatttgatacggacatgcagtgttaccaaaaatataacattttcattactttgttttacaaaatataaattaaccttgctatccatttaacttggtcaatatttaataaattgtggttgaaatgtatgtgtctgtcagaaatttgcacatatcactttgttttctaccctagagtaaaatccccaattattgtagggattcagaagacttggggaacaaggtgtttcccaggcaaatggaggggaagtcagtggagccctgggtgggaaagagtatatgggcctgggcttggattttggcagtgatttttattagctgtgtggccttgaacttcagtttccccagtcataaaatggagatcatcacatctactttgcacagcagttgtgaagattaattgtatcttcagtgagtgatatctatgatttaaaaatgactagataatgatttcaagtcaatatttaagacagaaagagagggtggaaatatcaagtacaaaagtgctgcggaaagtcaatagtcaacgatcctggtggatgggaggtctcagagacaggggaattgggcaccgcttccacgcacacgagaggagaaggacacagaggcagagatcagcagagcagtgggcatggaagagggaccatggggttggctgggtgaggcttggtcaggaaagacaaaggggtggcggtaggagcccccaagggtgggttgagagctctgtgccttacacaaagagtgaccctgaactgtgccttatacagaggtgacaagaagtgttttagaagggagatctggtaaacaaaggggcacatggagacaagcatgagggctggatgtgcccctggcctgaggacagcaaggcctgaacccaggaggggtgtggagagtgagatgaagatgagaatctcacagtcacaaagaagacgatatagggattagctctactggaaacaggagtggaaagagccaaaatggtctccgaagctttgatctcttccgatgaacaattgtttaaagcaacaataatgacaataacaaaacagtcatcccttggcatctggggggtattggttccaggactcagtttcttgccacgtgaatctctccagtttgctttgtcagagcaagcacgtgaaaagaatctgaacaagatggaagtcactgtcttttataatctgatttccaaagtggcatccatcacccttgctgtgtttattcattaaaaccaagtcacgagtccagcccatatacacaaggagaaggaactacacatgggcatgaagacaaggagacaggggtcgctgggagccatgctggaagctgcctaccatactaggggactggagaagtggaaatactcttgaccaaaataggacaggaggatggaaataatttaggacccagatgatgaattcagttgtaatcatggtgtatgagctaatggcatggcatcagaaccagaatccacagccatttgagccatgggagagctctagaaagaaggcaagccacggacatggattaggaagcatcctgttttgaccatgttcaggacatgtattcttagcttcattgcacatgtctgcaaaacaaatgagtctgctacagggctgtcagacagggctgtggtttcatctgaaggttcaacaagaaaaggatttacttccaacctcactcacatggttgttggcaggattcagttctttgcaagatgttaggatgaggttcttgattctttacgaacagtggcctcgtgagaagtcttgagttggataatccaactcaactgtggctggatacctgacccacagaaactatgaaataataaacgtgcttttcaagccactaagttttggtgtgatttgttatgccgcaacagataattaatacacccagtttccaactctttgatcctatcagttaccataaggcacctagaagttttcccacccttccaagtcctcaaaatttatgcttttctggaatttgagagaaggtaatggtccacttagggaggaagctattgtttggtacatgcctccaggcaccctttctcctgctggacaactgcttctccagtctaatcctgctctagctttttgctgggaaataacactccactcactctttcaccttggacttcctgtgctcccaaacttggcttgggtccagactgtagtcttctgtgtccctgacctggatttctattccagaacctaaatgctgcatgtctaagctgatctggtcagcaaattttttatcgctcttgcatttgatagttggattgtggcattcctgaccttgcattgcacccgcacaaatcaaaacagccttggcagccctgtaagataatttgattccattccctagcaatacagggccaggtccaaagttaccaaatcagggccctgactgctcctggcacccagccctggcccatggcttcctgactgatcttcctgacctttgcctttccagctccaccacctcaaggaggcatgaacgatctttcagaggcatgtgccaagttctgagcttggtcttcccatccttccagggggtgtgggatgggacttggagttatgccagctcttcagaaggggatgtgcatgcaccagctccaagtagagttggcaataggcaccgctactcagtggcacagtggtgactcatgaaagcagtggggagtaggacatggtggcagagaatcagttcccaggccctgctcagcaattatgaaaaaggctgttaacttggcaccaggaaaatagagtaaaggtcgcttttcctgacttccaaggacttccacagactgaggccaacctgctcgcccaatgtgttctctactgtgagccctctgctctcactgtcactttctagtctggaagtcaaaaaattcttctccttcttcttctctttcttcttctcctccttctcctcctccttctccttctccttcttctttctcttcttcctcttcctctcctttccttctcattctcattcttcttttttttttttttgagacagggtctgactccatcacccagggtggagtgcagtggtgtggtgtcagctcactgcaacctctacctcccaggttcaagcaattcttgtgcctcagcctcccaagtagctggaattatagccgtttgccaccatgcctggctaattttttatttttagtagagatggggtttcaccatgttggccaggctggtctcaaactcctggcctcaagtgatccacccacctcagcctcccaagtggcctgctaggattacaggccactgtgcccagccaaaaatatttattattaataaatggatgagccttgtagaaattatgtggaacaaaagaatctggacacagaagagtaaagactgtatgctccacttagatgactttttagaataggcaaaattcatctaaagtggataaaataaaggtcatacttgttgccctggttagttacctggaaagggacatgagggagctttctggagtgatggaaatgctctatatcgtgataggggtgtgagttacagaggtgtgtgtttgttaaaataaggccgggtgcggtggctcacacctataatcccagcactttgggaggccaaggtgggtggattacttgaggtcaggagtttgagaccagcctggccaatatggtgaaactccatctctactaaaaatacaaaaattagccgggcttggtggtgcatgactgtaatcctagccacttgggaggctgaggcaggagagtcgcttgaacctgggaagtggagtttgcagtgagctgagatggtgccactgcactctagcctgggtgtcgcagggagactccatctcaaaaataaataaattaataaaaaatcggctgggcacggtggctcatgcctgtaatcccagcactttgggaggccaaggtgggtgaatcacgaggtcaggagatggagaccatcctggctaacatggtgaaaccccgtctctactaaaaatacaaaaaaaattagctgggtgaggtggcgcgtgcctgtagtcccagctactcgggaggctgaggcaggaaaatggcgtgaacccgggaggctgagcttgcagtgagcccagtatatatatatatatatatatatatatatatatatatatatatacacttaatttttgttactttgtcattatggcattttgatatatgtcaattttaccttcaataaaactgtaaaaatattaatggttgagtaagggcaggggagtggggtgagctacagaagaccctggaatggcagaatgctgaatgtcgaagctgggtatttgccgcataggggtttattacgctattctgtttactttgtacatgtttgaaaatttccacaataaagagtcaaaaaaaattttatggtgcacatattctgcaccatgtcctatgctaaagggcatgcacaggcagacaaggctgcagaatacagaaagaacaaaactgaagatggaatttatttttttacatttatttttagagatggggtcttgctatgttgctcaagctggtcttgaactcttgggctcaagcgaccctcccacctcagccacccaagttactgggattacagcattattcaacctgaagattggaagattttttttttttttttttttttttgagatggagtcttgctctgtcgcccaggctggaatgcagtggcacaatctcggctcactacaagctccgccttctgggttcatgccattctcctgcctcagcctcctgagtagctgggactataggcgcccgccaccgcgcccagctagttttttgtatttttagtagtgacgtggttttcaccgtgttagccaggatggtctcgatttcctgacctcatgatccgcctgcctcggcctcccaaagtgctgagatttcatgcgtgagccaccgcgcccagccaagatggattttttacttacaaacataaagtgcattgaaaagggggaaaggtggactaaacggaaagtcatgccagccccaacatgtggctccaagaagagaaccctgcaccagaagggaagtcatccaactgcttctttcatggctcacaacatgtcacgagaccatcgccagcagaactaaacactgggcgaagcgatgtggttgatttacattctggctcaggctctattcttgaaccatcagccagaaatgtgaccaacactaaggcaatgatttattagattcacctgggagcacccagataaactaaatcagaatcccttgtggcagggctcggcatcagtgtattttgatgttccagatgcaattccaatacacagccagggcaagaaccagcgatctgtgagctgctcaagtcacattgcttccaggaagtctctcttcatgctcgctcacaaagagccttcttttatccaacaccctaaacattgctgactgacagtctgctatctaggtatatggggccttgtactgttttgaacaattcatgcttgtcttctttaatgaggatgtctgcacatgtgttcttgagggtaagaattaccttttacatttttgcattccccacaacactttgcactatgatgttcaataaacattcaattttcaaatttttatttagacaatgaaatatttccttattataaattggctgcattctttaattctcagagtactgaactaaatgattaatcattactggaacatgttctttcataatgaaaatactaaaagatttataaacttaaacataacttttcagttatttaatttggggattttccaagtcaacgtatttcctattgaacagatttttgtctatattatttttgctctctgacctgatgtgaatctttcagacgctgggttggttgaaggggaaacagtttttctaatgcagctactgtgagctgagctgacttaggccttggagaattaccattcttaccaattgaccacaaaagcagataggaacagtatctacgtattacaaaccagaatcaaaatgaccttcacacatgattagtgtggaattcttttcagtggaaaatggcaacatttagcagcacagggtgcagttggcttcaaatactctctgaagtgaaaccattgtgttttcctgggtgactgagcccagggctaatgcccatcggagaagctgctgggaactgcaatgctttgattaaacagagtattaaccacaggctggctgtttgaaccatatcgataaagacaaaattcaccctatctaccaaaacattctttcatgtaagacttaacaatgaaaataaacaaaagctttagctgtcaactatatataccatgaagaatggcaaaactggtttttgttaatgctattttgtcttttaatcgctcagttggctatgaaaactcttgtttacattcctttacatattgttgagcttcaaggtaattgtgaaagaaaacggggaattaatatcacttcccagaagccacattttatttaacctcaaaaactttatgtaaaagattttgttatgaatcaaaggctggcagttcttcccactggggtgatttaggaaattaaagttaggagtagatggtgctaatgggaatggtaagactagtaagagtgatttattccttgcagaaaaaaatcactgtcgatgctcagttgaaataatgtggaatttaataattacctcatagtaccatctagtggtgctatatttctacccttgtgttaagtgaggactgtagttttctgtagcccgaagccagcaaagccaggtcagtggtctattacaaacactttaactgtaagctgttagaagggtgagttcacagagaaaatgtaaacaaagtattagtagctcatatgacaatattaaattttaaaatgttcccagaactcagacatgttcaatatggattctcaataaattgtgtttttaaatattgaacaaatactgtgattacttttttcacaataattacagcaatttgggtagttttgggtactaccgtaagattctaagcactattttatatttttcctattctgaacaattgtggtttgtgcatttcttccagtaaatgcggtctggaaaataaatacctttcacatggtacgtgttattggaaaacaattgtctttagtgagatttatggaatgtggagaaaaaaaattttttaaggaactattgctcctatgaaagcttgagagtgttacgggcaatgtaggcacttttagatcaaattcaaacataaaaaggcacttacacacattttaagaatacttgtaattataagcacattttcagatttacaggactaagtctagtttaagcataaaccagattcaatgtgaatctctatatatttttcttgcttcaagtattattttacagaagggacactgatttgtttggcctgtgtaaacctaagaatctaggtttgatctagtagatatcatatctagtagatgtcatatctcaacaataaagggtctgaagaataaatattaatatttaggcctaagttattttttaaaattcataatgtgtctgtcctgttttgcttactgaattaacaaatctttaaagaaaaccttcatatattatagcgatatatttataccacagtgatatgatttattgaatgtgagagaaattctcacactcaattttaattttcttaaaaagaaaagatgggaaaatgttacagtatttaaatagtgaatgctgggcggcgacggcgacatggagagcggggcctacggcgtggccgaggcgggcggctccttcgacctgcggcccttcctgacgcagccgcaggtggtggcgcgcgccctgtgcttggtgagcccggggagggcgggccgggggcaccccgaggaccccccccgccgccaggcccggcgggacccctaacccacgagcgtgacaggtggaggcggccgcgtccgggccctggcggcgagcggggcgggcatttagcgtcccgggccccgccttcccgccctccacagtcttcgccttgatcgtgttctcctgcatctatggcgagggctacagcaacacccataagtctaagcagatgtactgcgtgttcaaccacaacgaggatgcctgccgctatggcagtgccatcggggtgctggccttcctggcctcggccttcttggtggtcgacgcgtatttcccccagatcagcaacgccactgaccgcaagtacctcgtcattggtgacctgctcttttcagctctctggaccttcctgtggtttgttggtttctgcttcctcaccaaccagtgggcggtcaccgacccggaggacgtgctggtgggggccgactctgcgagggcagccatcaccttcagcttcttttccatcttctcctggggtgtgctggcctccctgacctaccagcgctacaaggctggcgtggacgacttcatccagaactacgtcgaccccagtccggaccccaacactgcctacgcctcctacccaggtgcatctgtggacaactaccaacagccacccttcacccagaatgcggagaccaccgagggctaccagccgccccctgtgtactgagtggcggttagggtgggaagggggacagagagggccctcccctctgccctggactttcccatgagcctcctggaactgccaaaccccctctttcacctgttccatcctgtgcagctgacacacagctaaggagccttacagcccggcgggggctggccgagccacaccccacgtgcctgtgcccagagggcttcagtcagccgctcactcctccagggcacttttaggaaagggtttttagctagtgtttttccttgcttttaatgaccccatccccgcctggagtggctagaagccagcaggcacccatgtgctactgacaagtgcctcagcttccccccggcccgggtccggccgtgggagccgctgttacctgcgttctctgccaaagactcgtgggggccgtcacacctaccctgtgcagcggagccggaccaggctcttgtgtcctcactcaggtttgcttcccctgtgtccactgctgtatgatctgggggccaccaccctgtgccggtggcctctgggctgcctcccacggtgtgaaggcggggctggtgctcatggcacttccttcttgctcccacccctggcagcagggaatggctttgcctgacaacacccagctttatgtaaatattctgcagttgttacttaggaagcctggggagggcagaggtgtcccatggctcccaaactctgtctgtgccgagtgtattataaagtcgtaggggagatgcccggccctgggatgctgtttggagatggaataaatgttttctcattcaaaaaaaaaaaaaaattagtgaatgcttttgtaaaatagcagccaaaccaagaccaaaatgtttctttagtgtactttcatgcttaatgctgacagatagcattgtttgaactcacaatcaattttttatatataccttttcattacaaaacaaataatattcatggcagaaaatgaagaaaaccaaaaaacaaaaataagataagaaatttcacctgaaatcccaacacttaaaatgccatttaaaatattttcccaagtagccccattttttaaaatgagcaaattagcttcccacttaacttctttcacttaatactaaactgtgaataactttcacagtgtgattttcatttctgaaattgcccagcttctaaggcccactgcatgcaaggaatttagctaaaacacatagtccttgaggagatgacagtctagaagcagagacaatatacactgtagttaatgacagttaaaatgtccttaacaagattaaaaactcgtgggaaaagaatgaaatcctgtcattcacagcaacatggatgagcctggaggacataaggctaagtgaaataaaccaggcacagaaaggcagataccacatgatctctctcatgtagcgtcaaaaaggttgatcacatagaagtagagagcaaaacagtgattaccagagcctggggaggggaaacagggatgggaagaggttggtcaatgggcacaaagttacagttagacaggaagaataaatgctggtgttcccgtccatagtacgatgactacagctaataacaatgtagagtatatttcaagtgagctaataaagaggatcctgaaagttatcaccagaaataaatgtaaattttgtggtgaatgatatgctaactacccagatttggtcattatacaatgtatacatgtagtgaaacatcacactgtaccccataaatgtgtacaattattatatgtcaaatataaacactttttttttttgagacggagtcttgctctgttgcccaggctggagtgcagtggcgcaatctccgctcactgcaagctccgcctcctgggttcacgccattctcctgcctcagcctcctgagtagctgggactacaggcgcccaccaccacgcccagctaatttttttttgtattttcagtagacacggggtttcaccgtgttagccaggatggtctctatctcctgacctcgtgatctgcctgccttggcctcccaaagtgctgggattacagacatgagccacagtgcccgtcctaaacatgttttttaaaagaacacacaaaaaagaataaaattccctgagaactagctttatttcttccatttctgtggtctcctggtctcagactggaattgttttgttattaagtaaaaaccagccctcaactggccaaagcacaaaggtaagtcactgactcatgtaactaaactccctaggaacagacccagcttcagacagagctggatacaggctgctcatctgcctaatttggtctgggtgctgctccttggctcttggttagcttcctttctgttggttcctttctcctttgcagaggcaaaaacagcacacgcttttagttggagtcttgctgcctcctgggatgttcttcaccaccatcctggggattcactttgactcaatcttgggttgggttctttgtctccttatcccatatattcctcttctttgatttgctctcttattttggtggaggctccactctactagtttcctgagagaagctgccttggaatgaaatgttttgagactttgtatgaccaaaatgtttctttagtttacccttgtggttaatagttttgctggtgtgaaagagactgccagtgttacatatatcttgtcctcctttctttcctgggtacatgacgggattacctttgcaaaggactaacagtatctttgcagttaggtagtcttgtgatgagtgtagccaataaaatgaaaaaagaagtgtgtgacctccaggcccagggaattaatagcttgggtgctactccaggctctcttcccctgctgcaggagctttggaggccccttgtttcagagcaacatctcaaggtgaaaagaacctggatacctgaatcacaggatggaggggatcacctgccaacttgcctttgcatgaacaagaaggaagcgttgttaggctggcctactgagatgctagggtttctttctttccttcattttaaaattgcaacgttatctcagtggaatagattattcttaggtgcatcgttcatataaagaaaaattcatgtaatcccagcactttgggaggccgaggcaggcggatcacgaggtcaggagatcgagaccatctggctaacacagtgaaatcccatctctactaaaaatacaaaaaattagccgggcatggtggctggcgcctgtagtcccagctgctcaggaggctgaggcaggagaatggcgtgaacccgggaggcggagcttgcagcgagctgagattgtgccactgcactccagcctgggcgacagagcgagactctgtctcaaaaaaaaaaaaaaaaaaaaaaaaattcaaaacactcctgagggatacaaagaaaagtcaaagaggtggaaatctgtaatcttggaaaggaagattcaccaccaaaacagtaaccatagtggagagtgtgttaataataaagttgatgcaattccaataaatatcccaacaggattttcttttttgagggagagcgaaacaatctgattctaaagttaatgtggaaagaaaaactctaaggaaatataaagttaaattcggatctcacacctgactccaggataaattctagttgattaaaaaattaaatgtaaaaaaaagataccataaaatattagaataaacaatcatacttgttttgaatcaaatgctggggagggcatttctaggtacaacataaaactggggagccatcacagaagagtttgatagattcaattattctaaaatcaaaaagaaaaaatccacatgtaaaaaccctccccaggcaaagtcacaagacaaacagtaaactggcgagcatttgcaactcaaatcacatataaagaataatttcattgctgtatgttttagtccatttgtgctgccataacctgagatgggtaatttgcaataaatagaaatgtattaacccacagttctggaggctgggaattcctgagaggtcagtgtctgacaaggaccttcttgctgcatcatcccatggtggaaggcagagggcaagagagagggcaaggggctgaactcactcttttataataacatcaatcccacccatgagggcagagcccccatggcttaattacctcttaaaggtcccatctcttaataatgttacaatggcaatttaatttcaagggtatgtgccaccacacccagcaaattttttttggtattttttgcagagatggggttttgccatgtttcccaggctggtctcaaactcctgggctcaagcgatccacctgcctgggcctcccaaactgctagtattacagatgtgagccactgcacctggccttgtctcattttaatgtctctctggacctgataattaaaaagacttgcatttctcagataaaagtgattttctttttctcaaaaggatatgaacagagagaaaagaaaatgcatatggatcttcaaagatgaaatgatgttcagtctcactcataataagtaatttcacacaaactacaatgggatataatttttcacccactagaccaacaaatacttcaaaatttgataacacattgtattactgaggatacagggaaacaaggacaatcacaaattacttgtgggagtctaaattgtttgtaacccttacagggcacaatttgacaacatctaggaaaattttgcatgcaaataccctttgaaccagcaattctcttttaggaattcatttatatttatagatatgtgacatgatgtgtgcacaagtctcttcatggtgacactgtaacagcaaagacgagataagctaaacagtagtcaacaggggattgcttaaataaataacagtacagccacacaaagaaatattctgtagctctaaaaatgaataaagaagctctttatgaacagacatggattcatctccactgcatattgctcagtgaaaacagtgagttgtagagtatgtctacattatactactatttgtggttttcttaaatgaggaaaatatgtatagcttttgcatgaaaaaaatatctctagaatgaagtatgtacaaaaatctgttaatcatgactgttcatgggaaggggactggataggagagaaggtggaagggagaattttcaccattgatactttgaacccattgattttgggaccaagtgaatacactgcttatctaaaaattagaaatagttaaaatttaaaaagaaaatgtgcagtggctcacgcccgtaatcccagcactttgggaggccaaggcaggcagaacatctgaggtcaggagtttgagactagcctggccaacatggtgaaaccccgtctctactaaaaatgcaaaaattagccaggcatggtggtgggcgcctgtaatcccagctactcgggaggctgatgtaggagaattgcttgaaccccggaggtggagcttgcagtgagctgagatcgcgccactgcactccagcctgggcaacagagtaagtctccgtctcaaaaaaaaaaaaaaaaaaagaaaaaaagaaaaaaaatgtgaagagaacagtttgggcacttgaaacctacctttcagcatcattggtgatgtaacccttggggtggtcagtttataggccacacgtgtgagagtgccactctgctgtctagtctatcttagcaattttagggacactattgctgtgaggagtgacactgtccctgtccaccatatgagaagaatgtgggttttggtttccatttgctaagatgacattcagctgatatagtccagaggaaagaaaggaaaacagagcaactcccttttgatatcttagttgatgacagccataattagtgagtaagaaaaaatgaaaagatttccagtcgaagatgactgactaaacatgagaatttacccttcctccctgtttaaatcctatttcagggaccaaagggatataaaatggagagtaattctgtagcagcattggaaatttagaaaaggtgctttttgtgttttaaaaatagatttagggggtacaagtgaagttgtgttacatggatatattgcatagtggtgaagtcggggacttttattgcaactgtcacacaaatagtgtacatgacactcattaggtaatttctcatccctgagccccttctcaccctcccaccttttggagtctccaatgtctattgttttattctcaatgtccatgtgtacacattgtttagctccacttataagtgagaacatacactatttgactttctgtttctgagttatttcactgaagataatggcctccagttccatccatgttgctacaaaagacatggtttcattttttttaatggctgagcagtagtccatgatgtacatatatacaccacattttctttattcagtcatccattgatggacacttacgtttattccatgactttgctattgtgaataatgctgcaatgaacatacaagtgcaggtatctttttcatataatgatttcttttcctttgggcagatatccacgagtgagattcctatatcaaatggtagtactacttttatttctttgagaaatctccataccgttttccatagaaattgtactaatttatatttctaccaacagtctataagtgtttccttttctccacatccttgccaacatctgttgtttttttgacttttcatagccattctgactggtgtaagatttttgtttgtttttttgagatggagtcttgctctgttgcccgtgctggagtgcagtggtgtgatctcagctcactgcaagttctgcctcccgggttcactccattctcccacctcagcctcccgagtagctgggactacaggcgcccaccaccacgcccggctaatttctcttttctttttgtatttttagtagagacggggtttcaccgtgttagccaggatggtctcgatcttcttgtgatctgcctgcctcagcctcccaaagtcctgggattacaggtgtgagccaccgcgcccggccaagattttatctctttgtggttttagtttgcatttctctgatgattagtaatgttgaacattttttcatatgttcgttggtcacttgtatatatccttttgaaaaatgtttattcatgtcctttgcccactttttaatggggttatttttttcttgtacagttgtttgagttccttgtacattctgaatattagtcctttgttggatgcagagtctgcaaatattttctccctagacttcataaattacttcagtaaagtttcaggatacaaaatcaatggtacaaaaatcagtagcatttctatacacctataacaaccaagctgagaaccaaaccaagaactcaatcccatttacaatagctatgaaaaaaatacctaggaaaatatttaaccaaggaagtgaaagatctctacaaggagaactacaaaacactgatgaaagaaattgtagatgacacaaacaaatggaaaaatatcccatgctcctggattggaagaatcaatactgttaaaatgatcatactgcccaaagcaatctatggattcaatgcaattcctaccaaactactgtgttagtctgttctcaaattgctacagatacatgaaactgggtaatttttaaacaaaaaaggtttaattggctcacagttctgctggctgtacaggaggcatgactctggcatcttctcagtttctggggaggcctcaggacacttacaatcatagtggaaggcaaagggagagtgaggagtctcacatggtgggagcaggaacaagagagagaccggcaaggtgctacacccttttaaacaaccagatctcatgagcactcactcactatacagtaccaaaagggcatggtactaaaccattcatgagaaactgccctcatgatccaaccacctcccacgaggccccacctccaacactggggattacaatttcacatgagatttggtggggacacagatccaaataatatcaattaccaatgtcatttttcacaaaattaaaaaaaaatcctaaaattgatatggaaccaggaaagagtctgaatagccaaagcaatcttaagcaaaaagaacaaagctggaggcatcacattacctgactttaaactactctacaagtctatagtaaccaaaacagcatggtactagtaaaaaatagacacatagatcaatggaatggaatagggaacctagaaataaagccacatacctacaaccaacagatctttaacaacataaacaaaaatatacagtggggaaaggacaccctattcaataaatagtgttgagaaaattggccagtcatatgcagaagaatgaaactggaccaatatacaaaaattaactcaagataggattaaaaacttaaatgtaagacctgaaactataaaaatcctagaagaaaacctaagaaaaactcttctggacattggcctacacaaagaatttatgattaagacctcaaaagcaaatgcaacaaaaatgaacaaagaaaaacaggacttaaactaaaaggcttctgcacagcaaaagaaataatcagcagagtaaaacgacaacctacagaatgggaaaaatatttggaagggatgtttttaagagatcagaagagacaaaacattcttgaagatataaagtagatggaatcagattggtggcagttctagaatttgggtgcagaataaacctgctagcattgctccaaaataaaacaagaaattgtactaaaggtttaggtagtgctaaagagaaagagagggctgggcgcggtggctcacgcctgtaatcccagcactttggaaggccaaggtggacagatcaccagagatcaggagtttgagacaagcctgtccaatgtggtgaaaccccatctctactaaaaatacacacacacacacacacacacacacacacacacacacacaattagctgggtatggtggcacacacctgtaatcccagctactcgggaggcttaggcaggagaaggcggaggttgcagtgagctgagatcgcaccactgcactgcagtctgggtgacagagcgatactgtctcaaaaaaaaaaaagagagagagagagaaagagaggatgttggggctggagaatagaatcagtactctcaggtaacagatgcatggagtggggacaaggaggatacctactaagaagtcaagcaactcggagaatctaaatgtcagtctgtctagtcacaggtcaactcgttgctatgtcagaaaagcaatcagttctagaaaattaaaaacacattctaaaataaaaaatcgaatgactgtttcacaaagaatgggcctaaccgaagatcttatcagagagctgaaagactgaatagaggaattctcttagaatacagtgcaaaacaagatgacagggataaagccgaataagtcagcaattataattaatatgaccaatgtgtagtgctcatagagtacttgggttcaaatcctgcccaatcctttctgatcttgggtaggtcatggaatcactcaaatcctcagtttcttcagctgttaactggggacaaccagaagaactacctataggctaggtctgagcactgtataaaataacgcgggtaaagtgctcagtagaatacctgaattgagaggactcaatactgcttagctacgttcctatcactattaatattactaatgggccatcagacatgctaaaaataaatacctacaacagagtggagaccctgtcactaaaaacataaataaataagtaaataaaatatacaaccacactaacattcacaaaagtattctaaaataaaattattcaggaatgttgaaaattaaatgacaaaggtagtcacttatttacaaaatctgtgaaagatgagaaatgtgaaattaaaaaaatggaatttaaagccaaaaatattcaataggacagattttatatttacacataagaatacgaagacactagaagagcaatgaatctttatgcctgaacaacatgctatcagaatatataaagaaaaatgaattgataagttaacagtcaaaatgagaggatttagtaactttctcaggaaagaactgatttaatagacaaaaagcagttttagattttgagatcacaaggctgactctgtagtaatatacagaaatttgaactcagtatagaatatacactctttgtaagtacacgtatactatctacaaaaattgacatagtaataaaccaaaaagtctcaatgaatttcaaaaagcggaaaacatttaggctaattttctaactaccatgcaataaaaccagaaattagaaataacaaagaaaagaatatccccaatcaaaaaaaaaaaaagaaaaagaaagaaaaagttatatgtatttggagataaaaacaaagcaaaacagagaggctttctgttatttatgcgtaaaccaggaaatcatggttgcgattgccaacagtttatgctgggacaagggctcagtgtagtaaagccagcaggatgtggccaaaaaatgtaagaagacaagggaaaataaatgaactctaaatattaggagacaaagcatagaaagtagaaattttaaaataaaaaagcagaaattaatgaaacaaacaaacagggcaaacaacaaaatttgttaagccccaaatcgagttctttgaaaaatagctaatacaactgtgaaactactggcagacctgacccagaaaaaaaaaaggaagaattagaaaagaaatataactataaatagggaagagatttaaaacttgtaatcaactctatagaaataaattggaaaatgtgtaagaaatgaatatttttataaaaatgtaaactaccacaattaacgaaagagtcagaagacccaaatccttgctggttctgttgaagaaatggaaaaggtagtcagaggtccggccctgaaacaggcggcagatataggtagtgttatgggggatgctagtgaaccttcaaggagcatgtgattccagttattcaaactgtcagagcacaggaacagatggaaagttttccttctccttccaagtctagcaaaatcttgataacaaaactcatttgaacgataagtatatgaagtaatgcatatgttaattagcttgatttagccattccacagtgtctacatatatcaaaacatcatgttgtacaccacaaatatatacaatttttatttgtcaattaaaaaaataaagtcaaaacaaaacaaatttgcactcaaggggtacagaggtttgcatggaaatgcttcaaaaaggcctggaaataatccagatgctagcaggctacctcctagtggctggagaaagagggctgtcactttttaccctacacacttctgtacaattttatcttttttctttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgacatcacgcccggctaattttttgtatttttagtagagacagggtttcaccgtgttagccgggatggtctcgatctcctgacctcgtgatccgcccgcctcggcctcccaaagtgctgggattacaggctcttttttcaataagtatgtatgagtggattaacaatggaatgattgtttaatgcattcattattttattactttttaaaccataagaagaggtaggaagtattatctacataaggggttggcaaatttttttctgtagagagcaagatagtaaatattttagtctttgggggccatgcggtctgttgcaactactcaaccttggtggctagcatggaagaaaccacagactatatgtaaatgaatggatgtggctgtgttccgttaaaattttatttcaaaaacaggctgcaggttggatttggtccactgccatactttgctaaatctgatttctatatcagtggggaaattggtattttgatatattttattaagcctcagtccaatattttattcatttatttaaaaatatttactaaagacctttatgttccaggcactgctgtaggaactaggagtactgggaacataccagtgaataacacaaagccactatcgtcatggtggttgcattctattctgagaaaacagacaacaagcacatgcagaacaaaaacaacaaaacaaaacaaaacaaaaaacatgctcaagagtgatcaatgctataaagaaaacaaagcaggataagagatagagggcgctggagtgggggttggtacagttttagaggggatggtaagaaaagcctctgggccgggcgcggtggctcacgcctgtaatcccagcactctgggaggccgaggcgggcggatcacaaggtcaggagatgagaccattctggctaacacggcgaaaccccgtctttactaaaaatacaaaaaattagccgggcgtggtggcgcgagcctatagtcccagctactccggaggctgaggcaggaaaatcgcttgaacctggcatgcggaggttgcagtgagccgagatcgcaccactgcactccagcctgggcgacagagccagactccgtctcaaaaaaagaaaagaaaagaaaagtctctctgaacgatatgtgaccatcagggagtgtgaagtcctgagccagaaccaggagaaggctgatgtgtctacagggggctgagaggcgggtgatggggtgacggtggtgcagggaatccagggtctgggcagtgactcggaggaagacaacatggtgagcagttgtaagatcctgaacacagtttgaaggtggagctggcaggaatactggtggctgggatgtggagtgagggaaagagaagggcggagaatgattcaagtctttggacagaatggccatttgctaagacctgagcaagtaatgggtttggtggggcgctagttctgagttgttgttgttgttgttgttgttgttttgaagacggtgtctcactcttgttgcccaggctggagtgcgatggcgctatctctgctcactgcaacctccgccttcccggttcaagcgattctcctgcctcacccttccaaatagctggaattacaggcgcccaccaccacacccggctaattttttgtatttttttaggagagacggggtttcgccatgttggccaggctggtcttgaactcctgacctcaggtgatccaccctcctcggcctcccaaagtgctgggattacaggcgtgagccaccgcctggttttgcatgtgttgttggggctgcctgttagactgcaagtggcttctgtgaataagcagtgaattggagggtctggggttcagggaggggtcaggctggagaggcaaatatggtacttatagggtagaggcccatgagatcatcaggaaaacactcggagagtgtgcaatgaagaagacctggggccccggagcaatataaggatacaggatccaggattcagaaaaagagaggaaaagctgggcaagagagcaaggaggaacagggggaagtgtgagcctcagaacccaagagaaatgttaatgaaaggccaaaagatgagaaccaagaaggttctcactggcaaccttaacggaagagtggggtacagaataggttcaagaaggaatgtgatgtgaggaagtcaaatccagcgcttggaggccccggctttgggacagagaattggtccctgcagagcacggtctgaggccagtgtgactttcacctctgctcactgcaggacaaccagagagctccatcccaggctgagctgggctctgaaattaaaaggtggattgaaaaggttccttccccttttgtgtgtatgtcggggtaggagggggtggagggtgagggctgctggaagaaggtgaggaatgaaacaaaaatgggcaatacattctgataagcatgtaaacaggggccaatgcaagggtgtatggaaacagaggaggctcccatcccatttgtccaggtctgttcagtggaggacaaggggagtttgaaaataaaatgcccaaggatttaatcaaccaaagagccaggaccctccatacgtacgatgttgccatgatgaccatgcccgtgtgggtggtagtttggccgtttcctatccaaggcggacgccccggtgggcaggggtaggtgggaggcctgtgtttccatcctgaagcttaagaaccaggccggcccatctcgggtttgtgtctgggcacatgcaccctgtgggtgagatgcaccaggtcattgtaggccacaggctctggaaagggcacagaacacggggcctgaagcaagtcacttcagctcagaacctcagtttccaagcctgccattttggggaactggggttcatgataccagggagtgaaaaattctaggtataatacatgaccagcatttctttctacttctcccacacgattcccttttcagcagattaaatgtttgtgagccaaagcacaacgtgggcttcgcttctctctgcatgcttcagccttgtccagacatggcgtgtcacctgtgtctccggcagtcaccagctgtcctccaggctgctgctgtgggcttctcattggtggatccgaggtcctggatactgtcgccttggtgaatgcacagtgatgcgtgtggggaggtgcagaagctcttccgagttattctctgcacttacagattgagtttatcccgtgatgaagctcaaaatcagttatgcttttctatctcctctgttgtatttctcctcaacgtccacttctgtgagtgagtaaggttgtctgttttgacagctgaatgaacagaaaaaggaggttttaaaagcaaaagtctgctgtgtcccagtttcccagttaactccattctctctagccattcatggcatggagacagaaaaatcacagagcaatcagagtgcattttctgaaatcagtctcaactgcggagtgggaacgtgccactctgaggaacttccttccggcccggcttttgtgacatgtcgtgtggtagcggtcgtattccatcccaccttgtcctccaatgctgagctcaaggatttgggaaagcacatggtcccaccccgaggtcacagggagggctttcgccacagcagatgtgtgtgccgttcacatgtcctcgacagccagcggagtcacaattgattttgatgttaatatggcaaaatccattagggagaaaaactttcccccattcattgactcacaacccaagtagaaattgttttttgacattatccacattcctgttcttcccatgaggcatatttgaggcgggcagatcacctgaggtcaggagttcgagaccagcctggccaaaatgctgaaacaccgtctctattacaaatacaaaaattggctgggtgtggtggtgcgtgcctgtaatcccagctacttggagaagctgaggctggagaattgcttgaacccaggaggcggaggttgcagtgagccgagatctcaccactgcactccagcctgggtgacagaaaaagactgtctcaaaaaaaaaaaaaaaaaagagctgacattctaggtgtttaataataccatactatcatatctagtgtgataaaataacaacatgcattttccacaggactatatttcaaaagagtatgagatgattatattatatttttagaccaaagtttcactgatgcagaaaaatctgtaagttgcaggtttatttttaataaacaaaatcgactttatgcaccttgtaggttaacctaaccgacattattgtaatttattcagtaggtagggaagtttgaactctactcttgaattcatggcgggatatattaatagtagggagcatgcggggaagtacgcagacattgttagcaataagcagtgaacacacagggagtggtgatataaagataaaccaatacagacagaatgtccaaataaggccccagtagggcatgttttccacgtttcctagcagggttgggaataccctatttagattttcagaccagaaaagggtaatgaagtcagagagattagcctgggcagaaagggaagaatggaccaggggccatccattcttccctgtgctggtgagagcacaggtcacggctacagagaggggggtcaacctaaggatgcaggcagggttggctataacagttccttgggaaatggaagtgtaggaatattgttggcttagttttaaacccagaagaggaaatagctctggaacttaggctgggggatgggggcagaaaggactcaggtctttattcctagactactccagtacatatcttaccccatgggcacctgtatcaacagactctgagggaaaggtttgcagcagacatggaccttgaaaatgctggaaaaagagaaggtgctgatcctccccaggaatcagaagaccaaaagccttagaaactcaaagaaagaaagctatagcaggggggctactttggctcccagacttcagctctcagggccaacatagagctatgatttgaggactgttctttccatctgtattagttagaattcctccagagaaagagaaccaacagaatacaaacacacacacacacacacacacacacaaagatattgagataaacatctcagtatatatgtgtgtatatttatatacacatataaaatttgatgaaatgtattttaatgaattggcttaagagactgtgaagcagtagtagatccaaactatgcagggttgaccagcagactggagacccaaggaagagttacagttagattccaaatgcagtctgttggcagaattccttctttctcaggaagggttagtctctgttctattgtctttaactgattgaatgagatcccccacattttgaatagtaatctgcttttactcaaagttcaccaattaatttattaaattatttatttgagatggagttttgccctgtcgcccagactggattgcagtggcgtgatctcagctcactgcaacctccacctcccaggttcaagagattcccctgcctcagcctcctgagtagctgggattgcaggcgtgcgccaccacacctggataattttttttttgtatttttagtagagacgggatttcaccatgttggccaggctggccttgaactcctgacctcaggcgatccacctgcctcggtctcccaaagtgctgggattacaggcgtgagccaccgtgcccagcccaaagttcaccaatttaaatgttaatttcatccaaaaaaaaaaaaagaaacatccagaataatgtttgaccaaagatctgggcactgacctggccaaactgacacataaaattaattatcacaccatcttaacactgtccctgggtaaaggactaaaaaagaaaagacagaaggaagaaggagctaggacccagggataggtaggatgtatcaaggaataagaatcagcatactgtgtttccacaaaacacaagaaagaaagtaaaaatctagaaagatctgcagcactgtttaattcagtacatgtgcctcaggtatttctgggggctggttggggggccagtcccaggcaaactgaaggtgcggaagcggtggtgggattagcttagtcagcaggcctggtacgcatggactagttgcataaagtactggaagccttggacctgatggttgtcttcagagtaaaaaaggaggtaagcagaaaaatgcagtctacaagctgctgagtcagttaccacttagcatgacttgagtgccaaagatatgacaggcatagagtagtttggggcacagaagaacagatcagaggaggttacaggtttttgtgcatttaatccttacgacaaatttatgagacaggtgctgttctttatcctcattttccagatgagaatctaaggcatagaaaggtttagcagtttgcccaaggctgcacaatacttgtgatgcttaattttgtcttaacttagccaagccgtggtgcccagttgtttggtcaaacatcagcctacatgttgctatgaaagtatttttttagatgtgatgaactttttttttttttttattgagacagagtttcactcttgtgacccacactggactgtaatggcatgatcttggctcactgcaacctctgcctcctgagttcaagcgattctcctgccttagccttccgagtagctaggatcataggtgcccaccaccacacccagctaatttttttgtatttttagtaggaacagggtttcaccatgttggtcaggctgctctcaaactcctgacctcaggcgatccacccgcctcggcctcccaaagtgctgggattacaggtgtgaggagtcatgcctggccagatgtgatgaacatttatatcagtagacttcgagtaatacatatttcccttcataatgtgcatgggcctcatccaatcagtagaaggccttaagagcaaagactgaggtttcctgaggaagaaggaattctctttaaaactgtcacatggaaactctgcctgagtttctagtctcctgccccatggaattcagattcaagactgactgcaacattgactcttacctgaatttccagcctgtcagttttccctacagattctggacttgccagtccccatagttgtgtgagccaattccttaaaatagatctctttctctcagcatgtgtgcatattacagttacatataaatgaggctctgtctctctctccatactgaaagcaggaagtagaagaggaaaagaaacagaaatcacatttttgtcaaatcccagaggcacttgcagtccagaatcttgtattaggaagggcagtgggtgatggggcaaaccttacctcctggatggggctgtcaggacttcatgtctccatggagggggcccaccccagaaccaccagctcagccccagccagcaaaagcctcctggctcttcaggagcctgctatcacagggaacccaagtccacccacgtcaggctcagggaccttggagggctttgtcctgcgattacattggtctctatccagcaaaagaaaagttggaaagcagtctgtgtgctttctaaatgaacacactgtgataatgggggcccaaagtacatatttctaataacaaacctgattagaggtaaaattaattgtatatgctatttaaacatagtatatgttgagttgtatattatatttttttacaatacttactcatggttgtgccttggatgcttatatgccataagcaagttaaagaaaacatatggcttacataccaactattgacattccattcatgcctttattttttattgtttatttttattttttttgagacagagtcttgctgtgttgcccaggctggagtgcagtggtgcaatctcagctcattgcaacctctgcctctcaggttcaagcaattctcctgcctccacctcctaagtagctgggattacagactcccaccaccacacccacctaatttttgtatttttagtagagatagggtttcaccatgttggccaggctgatctcgaactcctgacctcaaccgatctgcctgccttggcctcccaaagtgttgggattacagcatgagccaccatgcccagcctccattcatgcctccagaggtgggaaggacactgcatggagtagggaccatttggatcgttgctttgtgttctcattttatgcaaattcttcctatcagacagtctgtacctgcaaggaatagccatgaaggcttaccgcagttcaagtgttactctagcccacaaaacacataatttatgagccaaaagagaagctggaggccatttatgttggagcaacttcaaaatgtctcaccagcaattaagactatttttgttttcctttcggagaagcattagcacacattttagagaatgaccgcttaatttataacctcttactcatattttagaggtttactactgaagggcagagttatttggaatgttcggaatgagttgcatcatcttgttttaggctccagcaaagaacaaaaactaagaacagacaccaggcacacacttcaacggcatcaagtgcccacagtcaaatggagtcaagtgcccacagtcaaataccattcttctcatactgcggaacaaccaaaaaaatcacacagtggcctaagtatgtcctagaaaatattagcatcagcaaaacaacgtgtaagtagccaaaggacgcagtggaacaagaactatgaggagaggaagaaaatgaaaagtaaaaagacaggcctttttaaagattacaaacacaccgagaatgttaacatacttgttacataattggagactttgttcttgatcttcagtgtcaaaagcactgctacgatcgggttgagttccaacccttgctttttcttctgcagcagatgcattttgtaaggtcctatgggtttattctgcattataacacaaatgggtatcacatttctggcaagctcacccactggttgcttttcttttttaaaattataacaatatgttgctggagatttagctatcccaaattgtatacaaaagaacaaacattattcagtttacatttctctaaacaaacatccattcattcattgaaaaataagtcattaccagttgttcaaaataaataagtgcttgtctcggctaggaatagagtggccctttttcaaaagtgcatgctgctatttttctgaacatgcggctttgagaggaaatacccacattcttttttaatttaatttaattttattttattattattatactttaagttttagggtacatgtgcacaatgtgcaggttagttacatatgtaaacgtgccatactgctgtactgcacccattaactcgtcatttagcattaagtatatctcctaatgctatccctcccccctccccccaccccacaacagtccccagagtgtgatgttccccttcctgtgtccatgtgttctcattgttcaattcccacctgtgagtaagaacatgcggtgtttggttttttgtccttgtgatagtttactgagaatgacgatttccaatttcatccatgtccctacaaaggacatgaactcatcattttttatggctgcatagtattccatggtgtatatgtgccacattttcttaatctagtctatcattgttggacatttgggttggttccaagactttgctattgtgaatagtgccgcaatgaacatacgtgtgcatgtgtctttatagcagcatgatttatagtcctttgggtatatacccagtaatgggatggctgggtcaaatggtatttctagttctagatccctgaggaattgccacactgtcttccacaaaatacctaggaatccaacttacaagggacgtgaaagacctcttcaaggagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccagtgactttcttcacagaattggaaaaaactactttaaagttcatatggaaccaaaaaagagcccgcatcgccaaatcaatcctaagccaaaagaacaaagctggaggcatcacactacctgacttcaaactatactacaaggctacagtaaccaaaacagcatggtactggtaccaaaatagagatatagatcaatggaacagaacagagccctcagaaataatgccgcatatctacaactatctgatctttgacaaacctgagaaaaacaagcaatagggaaaggattccctatttaataaatggtgctgggaaaactggctagccatatgtagaaagctgaagctggatcccttccttacaccttatacaaaaattaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaatcaaactaaagagcttctgcacagcaaaagaaactaccatcagagtgaccaggcaacctacaaaatgggagaaaattttcacaacctactcatgtgacaaagggctaatatccagaatctacaatgaactcaaacaaatttacaagaaaaaaccaaacaaccccatcaaaaagtggacaaaggacatgaacagacacttctcaaaagaagacatttatgcagccaaaaaacacatgaaaaaatgctcaccatcactggccatcagagaaatgcaaatcaaaaccacaatcagataccatctcataccagttagaatggcaatcattaaaaagtcagaaaacaacaggtgctggagaggatgtggagaaataggaacacttttacactgctggtggaaatacccacattctttgcaatatttaaaaaagggcttcatggaatcaggggaggaaggaaaaggaggcaccagaatcactttcaaatatggcttcttcctgagcctctgaccgatgatgcgcacgacttccccatcttgggcttgggtttgggcttggtccctcttgagcttgggaaccagaatcagagggggttctggctgacttctaagactcaccagttgaactcgtcttgctcttcctcgggatctgaccatgatttctgcctctgcctggacagcaccttcacagcacacctggttgaacgcttctgccacttggttccctcataggcctttccaccctgcttcccatcaggcccaagaggcaatggtccccagcaaagagctgatagcacatggattgaaaccttctgtgggtcccctttaactctcaaagcccgccccacgcacctcttcacccacccctgcccaaaccaccctccacctttgttcacgtcttctgctcctccagctcctgaaggcggcgtccatcctcccatcatcgtgtagtcagtggcagccctgtgcctgctggttgtaaacacataagcatgcaatcacactgaatcacgtcactgtggaaaagcccatcccaagagacaagctatgggaaagatggtttcgggaaccactttccctgagctttcctggtatgttcacacttcaattgcccttctagctctagctcttgctcatcttcccaatgggagaaggtcaggaacaaaagaaatgtggtggccactttaagaggtgggaaatgctgtagggatgagcctcttgcccctactccccagtccctgggaggtggctcttcccctgtaattagaggtgccagtcattctttttatggtacaagtgacctgttgcaacaaccagtattgtccacaaacaacattaaaatgtggatataaaacatgaagagacagtataggacttccaggccccatgaatatcactagccatgatagcgaaataccgcaggttcttgccttcagctttgtgctgaattgataatcctgccttctacggagcactctgcagccacactgctcacttggagctttcttgctgtgctaccctaggatgcagttatttaatagtctgtgtttctaatcacggcagctgattgtttttgtatcacaagaactataaggcttcctcagaatttatatgagctgagtctaccccatacagtgagaggaaatggatttccttctgaagttggatgtcgttataaccgatcataaatcaccctctttgggggcacccacaaagggtgagccccattgaacacagatggatcacccagtgctgagagggacttgagactttgcaaagtacttgctttatagcctgggattgattattacccagggcatcacttacaaacattagtctgaaagtctacattctgaccactggtatgacattcaggtagcaaaagaacttgaacattttcagattttcttttttctctctttcttttcttccttccttcctttctttcttttcttttctttttttttgagacacaggtattataaggtattataataataatacattattattattatttttgagacacagcttcgctcttatcactcaggctggagtgcaatggcatgatctcggctcactgcaacctccacctcctgggttcaagtgattctcctgcctcagcctctcgactagctgggattacaggcacctgccaccatgcctggctaatttttgtatttttagtagagatggggtttcaccatgttggccaggctggtctcgaactcctgacctcaggtgatctgcccgcctcagcctcccagagtgttgggattacaggcgtgagccaccacgcccagctgagaattttatttttcaaaaaaaaaaaaaaaaatctcaaaaacaatctctccagttaaactctggtaatataattgctatatctttttttaaaatacaacttttaagtagttttagattctcatggaagttgcaaaaacatgtagctttcattcagctacatagatgaataaatacttctcagaaaaaaattgtattacatgacagcctaaagtaacataagaagccattcataagtattcattttcaccaacttgactttttcaggggattgattattttattcaatgttatgggggctgtggaatggaagggcttgtaattaacccacaatttgccacaactatcctaaaagccaagggcaatttttccagagacaaatcttaaaatatatgatgtcaatatattgtaaaatataaaagcttaactttattacaaaagcttaaaatataagcctgggcccttatggttctgtcttggagaaatgtaggcaaatgaagaccagcaaccaaatgctgcttcaaaatagttcaaatccttttcttgcaattctctaaaacctgaataggtccacatgcacacaggccatcgtatcacaaaataggaattccctgttcttgcatctgtccccgttactcctgcaactttcccagaacatccgctgcagttaccttccccaaacccttctcttctgaccagccctgttcaccttttctttctcacactcttctttccctcccccactcttcatttctttatgacattggtcaacccaaaccctctcctagcaagaaagaatcttttctcttgagaaggaaggaggttgggaaattagaataggcaattataggtctctctttggaaggctgggagaagagaaacagttgggaagacttccatgccagtttttttttttttttgagatggagtctcactctgttgcccaggctggagtgcagtggcaccatcttggctcactgcaacctccgcctcccaggctcaagccattctactgcctcagcctcccaggtagctggggctataggcatgtgccactacacccagataatttttttgtatttttagcagtgacagggtttcacctcaaatgatccacccgcctcggcctcccaaagtgctgggattacaggcgtcagccacctcaccctgccccatgccaatttttttaaatgacaactttattgagatgtaatgtgcataccacagaaatcacccttttaaatatatgtaacatatttaatatattttaaaatatttactatattaaatattaacatatttatatttatatagcatattatataacatatttattatatattatatatttattataatatatataatatataatatattaatataaaatatatactatatattatattaatatatcattatatatgattacatattataatatattaatacaatatattatattaatatatgatattatattatcatatattatataatatatgatatatcatatattatataatatatgatatatcatatattaatataatactaattattataataatatattatataatgatatataataataatataataattatattatatatttatatataatattatattatattatttttattatttattttttattttttatttttttatttttattttttatttttattttattttattttattttttaaatttatttttatatttttattttattttattttatttttttattttttatttttattatatattatattatattatattataatattattatataataataatgtaatatattatattatatatatttatatcatattatataacatatttatatttatataacattatataacatttatatttaatattaacatatatttaatatattaaatatatataactatatataaatatttatattagttcagtagtttttggcatattcacagttgtgtgcaaacatcataatctaatctcagaacattttcattatctcaaaaagaaatactgtatctgtcagcagtcacttcccattcccccactacttctgctcctggcaaccactaatctactttgtctctgtggattttcctattatggacatttcataggaacggaaacctacagatgtacgttttgtgatgggcttctttctcttagcataaagttttaaaggttcatctgtgttgtagcatgcatcagtaattcatttctttttacaaaataatattctgttgtgcagagagaccatattttgtttatccatctggttgatgggcaattgggttgtttctactttttggctattatgaataatgctgctatgaaccttcttagaccagtttttcatggacacattttcatttatcttgagtttaggaaccaagaatggagttggtagatcatacgtcaactctagcattttgaagaaccatgatcatttttgtgcctctacgtgcagaatgaaagctaagtccagcttccttaacctattaatattttatgtcttgcacttaaaaatcctcattaaaacaagaaagatataaatatttctataagatgattagaaatcatccctcaggttgtgtcaggagctgtgcacggttttattgggcatcacagatgcttacttctatatcacgagattttagagagaagcattgggtatttttattaaagtaaaaatcaatgcagggttgaaactcatgattacatactgtggctgggtacctgatattttggttagatcataattaagcttactactttttagagcaaactatgtccttacctttgtaataaagaaaaaaacaggtgagtaggtaagggcagaattcctccagatgagagcagaaagcacagaaggcacttgcacctttgaaaaggagctacaggagaaaagcctccactctcttgggatagcaatcctgagggaggatctctcggtactcctttaaggagaacagccatcagacgccaagtgcgggagcgcctgactcacagtgaattccttcaggatcttctctttataactcatcagtatccgagagccacttgttcctcttctccttttctctctgtgttcttgtctcactgtcataaaaccaagacttggctcttctctcaaacatcctggtgtgtggagaactcgggaaatatctccctcctgggtcttgctgctctgtgccctccgtgggcaatgtccacaccgcaccgacacctacaaccaaaaccatactgccacctggaattattacagatctgcgggaggaagggaggcttcagattaaagccaggagctgcccaatgctgaccgtcctgtcccaagacaattgtgctgcactaatcaaccccttgccgcagtaaacttcaaaagacgaaaagagatgcagtctggctaacccctgatcaatgtaaatccctcctttatctccaaataatcatttccccagctccccacaccctcaaatgatgactttcaacactttgaatataacaggctcacagtctgtattcaatggtctcatcataaggcaggaagccctatcaggaactgcgctgctctcctatccctacacttcccaccacgtagttcggggttaggcagggaattgcagtaaagctatacacagtaaagaaaagttggtttgtgtgtgtgtgtgtgtgttgtttgtttgttttttgagaccgagtttcgctctttgcccaggctggagtgcagtgggacaatctcggctcactgcaaactccgcctcccgggttcaagtgattctcctgcctcagcctcccgagtagctgggattacaggtgcatgccgccacagccagctaatttttgtattattagtagagacggggtttcactatgttggccaggctggtctcgaactcctgacctcaggtgatccacccaccttgacctcccaaagtgctgggattacaggcgtgagccatcttgcccggccggcatttcagttttattaaactgtctactgcatgccagttcttagtagcacagtctctttttttgttttagaaactcaaaaccttctaagtgatcacctggttaaataatgcaatcccataaatgacccctctcttctgatccatgcctggtgtccatttaattaaaccagattagaaaaagggattattgctggctcagggaggctgctgccacagacaatgcctcacttcggattgtgcagatataatatgattgctccaagccagccttcatgtttacacctgcctggaagctctcaggccctggagtaacctcaggacactcctggccctgtctgcgggtaaccagttcttctctcagatgtgcggtctgtgctgttcctccccatctgccagtacaagtaaggtgtggcacctgggcccttctcccactcacattgcctgtgtcctctctctaaaagtcaccttaagaccatgcgggtaaagaggagtgacttaaaggagctcaaattcatcttacttttttccagttgggaaattggcaaaaagttctgtagttatggaaatattcttgccagtttatagaagcaattagatctttttctatagcatctgtgtggaagatttccttttcaggaaatcaaaactcctttgagtggcctgacaatagtaaccataagaaaataattttcctggaattgcttctgagctcgtttgtgaactggagagtataactttgtgtcactatactccattttactaaccatgtggttcagatgctttgtcattttggagccttggtgaccctggagagactgcgtcttccagggttagccagttcctagagatagcaaagaacttgcctgaaagcctgcctttcatacacaaatcaaccaatccattacagaccagcctggccaacatggtaaaaccctgtctctgctaaaaatacaaaaaattagctggacatggtggtacatgcctgtaatcccagctactggggaagctgagacaggagaatctcttgaacctgggaggcggagcttgcagtgagccaaggtcgcgccactgcactccagcctgggcgacagagcgggactccatctcaaaaaaaaaaaaaaaaaaaaaaaaaaaaaaaaaatcaagcaatccagtgctcataccccagccccctcctttctcagactcctatactctgggccaggatccacctgccctagtcaccccagggccagctaccagaatactacggacagccgtatgccccagtcaatcatgccccagaaattattcaaaccagtcagtgctaagtctgcttaccctgcctcacctgtcccttcccgtggaaaccacaagaaaggctcttgccctcgttttcctcctgctctgtctcctgacctacctggtgccccttcctcttgggaacagtaaaaaactctctttccagcagcagtcatctcctgatctgttggcctcatcacacctgaatcataataatacctatctttaataacagccatggaaagtataaacctggggttgggctgggacaacattgtgaagctcttttagcttcatgaataacggggccgggggcagtcacaatccctgctacactcttcagcagtagcaatttctggaaatgcagccctcattgaagcttccgagagaaagagtgccatcttgtggtattttgtagtttcttaggccatttcctttctctctcgctctctttttttttttttttttgagactaagtcttcctctgtagcccaggctggagtgcaatgacacgatcttggcttactgctcactgcagcctttgcctcttgggttcaagcgattctcctgcctcagcctcctgagtagctggcattacaggtgtgcgccaccacacctggctaatttttgtatttttagtagagacggggtttcaccatgatggtcggactggtcttgaactcctgacctcgtgatcctcccgcctcgacctcccaaagtactgggattacaggtgtgagccaccgcgcctggcctcctctctcttttaaatagatcatttttagagcagttttaggttcacagcaaagttgagcagaaagtacagacagttcccatatagctcctgcccctacacattcacagccttccccactaccaacatgggcaccagagtggtccatttgttacaatcaatgaacctatattgatgcaccattattgcccaaagtccatggttaacattagggttcgctcttggtgtgttggatattttacggatttggttgaaagtataataacatgtgtctataattattgtatcatagagagtagtttcactgcccccaaatcctctatgctctgcctattcattcgtccctcccttcaacccctggcaatgactgatcttttcactgtttccatagttttgttgcaggccatttttactccaagattttctttgtttggctgtccactttgtgctgggtgtgtaatatagactcgtgatgagtaagagagacagcctggagcatcttggagtccatattgggatggactcatgaattcctgtattttcctactccaggaaagaggtgcaggtaaggatagaaaaaaaagtcaagtagacaaataaaaataattaggctgggagcggtgacttacgcctgtaatcccagcactttaggaggctcaggcaggtggatcacctgaggtcgggagtttgagaccaacctgaccaacatggtgaaaccctgtctccactaaatatacaaaaattagccaggcgtggtggtgggcgcctgtaatcccagctactcgggaggctgaggcaggagaatcacttgaagctgggaggtggaggctgcagcaagctaagatcacaccattgcactccagcctgggtgacaagagtgaaactctgtctcaataataataataataataataataataataataataataataataatgtattatttacaggtaaagtaaattctgtagtgttcaagagataaaataaattgtctcaagcaaaagtcaaactaggatgatttttttttgttattcaacttatttagaaattaggtttttttgttcctgttgaattgttttgttctgtcttaggtactaaaaataatctttcattctttggagctgctgatatttactatgacaggcaaacaattgcccttctccataccaccacatttttgttgttaatattcctggtgtccataaatgtttttgcttctttctttttttgtctttgcttattcaattacctttacctagaaatgccatctccttacatctgtctatgcttcttaaggactcgcccaaatgttatctcctgcaagcaacagaaatctccactagctcaccaccacctctaacttcttcctggatttacctatttaggcatcagttatttactttttactaaaatacatgagaatttagctcttataccacccacttccccttcctcaaatattatctttagtcatataagtaatctctaattatcattaggactttgtagaataaagccaagttttctagaatatttaggataggatatttcttttcttggcgctgctttttgttttgcaggtcttcctcatagtagtaatttttaatttaaaaaaatgctgttgtagccctttctgtgagatctccttctcttttgaagcctttggctcctctgagcccatcttggcaggttgttctttcggttggctgtgcagatgccatcttgaggtttttcacatctcctctcctagagtagatccattgtttcctggatcccatgtcatctttcttggcttaacctttctcattttccctgacaacatcctcaaataaaactctaagaaagcatgcagtggtatcttttctgagctctagcttccaaaaaaatatgacccagtgtttgagttttggagccagtccgagataggtttgaatcttggttctcctacttattagctgtatgtccttgggctgattccctaattgccctatgcatgaattttccatttgcaaaatgggggaaccagtaatagtagtagtacctatgtttttagggagctatgaggatttattgaactggtacatgtaaaccatttagaacagtgcctgctgcatatcacatccccatcagtattcacgtctctcatattctaccctcacacttgattgatagtttggttgattatatatttctaggttgaggataattttaccttaaaatttcaaagtctgtgctgttgtcttctaaccagtcgtggtggtgaagcctcatgccatcctgagtttcacttatttatgcatgactttctccctggaagcttttaggagtttgtcttttccttgttgagctgaaatagcacaacagtgtacttagtgtgggtcttttttcattcattgtgctgggtacaccaaatggacaggcctatggataggctctttcaaagttggagtcttgaatcttgtcatatttttgttgttaactttctcttttccattttatttgttcattttgaagtgtctgttaattggattttagacctcttgtcttgagtctggtatctcacattatttctaaattttttttaaattttaagttctggaatatttttcttatctttcgactttcaggaaattttatttggactatcataactttaagttttgttttggttatttattgttgcttaaccaattatcccaaaacttaatggcgtaaaactacacatatgtctatctgtcactactgtatggattaactggggctagctggacagttttcttgctggtcttatttggcagctctcactgtgcggtcagacagtgttagggactggtcatctggatgctcagctgcagtggaatgtctgagacggcttcttcacccacaggtctgctgctttggtgtttcttcatgtggcctttctctctgcatagcatctcatcctctcgaatctcttcatgtggcttttctttctccaagagggtagccaattcttatttttggcttccagaagcacagaaatggagctgccaggggttcttaaggcttagacctggaacaggtccagtgtcatttctaccacatgctataggttaaagtgagtgttggggccaacccagattgactatgggatgggcctgtctaaggacatgatgacaggaggtatggctcattggagaccaactcccaagatggagcatgagttctaagaactttttcttctctgattatttcttattcatattgttttgttttatacatgtaatatattcacaagtgtctttatgaagtgattttgatactctttgtcttctccctggcatctctttgttctttaataattttttttcttagtttattttggtcttatttttctttttaaagcctttccttaaatatctattctatgttgcttatcatttgtagtcttttttttttttttttgagacccagtttcgctcttgttgcctaggctggagtacaatgatgtgatctcggctcatcacaacctctgcctcccaggttcaagcagttctcctgcctcagcctcccaagtagctgggattacagtcatgtgctaccacgcccagctaatttgtgtatttttagtagagatgggatttctccatgttggtcagtctggtctggaactctcaacctcaggtgatccacccaccttggcctcccaaagtgctgggattacagacatgagccaccgcgcctgacctgtagtctttttctcattcctttatttgctcattcatatttgagagaggtactaaaagactgggagccggggtgtggtggctcacacctataatctcagtgctttgggagaccgaagtgggaggatcacttgagcccaggagctcaagactagtttgggcaacatagtgagaccccatctttacaaaaaaaaaaaaaatagctaggtgtggtgacacccatctgcagtcccagctacttgggaggctgaggcaggaggattgcttgagcccaggaggttgaggctgcagtgagctctgatcatgccactgcattcctgcattccagcctgggcgaaagagcaagaccctgtctcaaaaaaaataaataaataaaaataaaaataaatcaaaattgattgggagttctttgtggccaagacttgtcaactgatagcttttagggggaatgtatgctgattcctaattgttatcctccatccctctatcttatctcctggtgcaatcataaatgatggctggatgactactccattcctctggatgtaaaatctacattgtcttgcctgaggtggatacgtttgcttgggttctgtttaaggagatggggccagcagtgtgtttcagggcctgtgaaatgtgttctctatccgggcttttgcttaatctctgttttcagtcttgcctatcagtcccactgtcgggggtacctcgtgtctgggtctagaacctttccaggttgctgtgggacagattagcctccttgttctcagtatccccctgacctccacctttgtttgctttgctccatgaattaaccattttccatgtactgtcattgtctaatgaagatgaattctcttctgttggtaaccccattccttttttgtaattgtgtgcttatacaatgtttattcttcactgtatttctattggagcctcaggacaaagagcagatggtaagaatatgtgttcagtgttaagttttccttctgtaagacatctgcaacttgtgtttttcactgaatagatcatggacttaatgcatatagagctactttgcttttcatgattttgccttcaattatatgtagaaatataatttgtgaattgcctaatgaatttttcctaattttgaatcatctttgcattcctataataaacactgttagaatggctgtggtaatattttatttttgcatttttacttctgtattaaataagattatagttttgtttgtttccaataaggctgttatttcatttcagtatcaagggtatgcagggctgagttgggaagctttacatcttttttctaagatctaggatgtagatctggtttacacagtaattttcaactgcaggagtattttgcctcctatgggacgtttcgaaatatctggagacatttttgtggttacaactggtcaaggtcgggaggtcttattggcattctgtgggtagagggaatgttactaaatgtccgacaacacaccaggagaaccctccacaaagaattatctggccaaatatatcagtattgctgaggctgacaaattctggtttaaataaatatccaatttggaggatgagtctttgtctttttccttcttctgcgtattggtctccagattttccacttcttcagttagtttttgtgactgtagaatcttaaaaaaaaaaatgaaaactttggccgggtgcaatggctcatgcctgtaatcccagcactttgggaggccgaggcaggtggatcacgagatcaggagataaagaccatcctggctaacatggtgaaaccctgtctctactaagccaaaatacaaaaaattagccaggcgtggtggcgggcgcctgtagtcccagctactcaggaggttgaggcaggagaatgttgtgaacccgggaggcggagcttgcagtgagccaagatcgcgccactgcactccagcgtgggtgacagagcgagactccatctcaaacaaaaaaaaaaaaaaaaaaaaatgaacatgtcatccatacttctaaggtgttgtaaagatgtgtaaagttttcactttttgcatcatattcacatgtggctatatgcccttttctcttcaaagttttctttatcttgattacttatcagaggcttgactgttttattatctcagtcttttgaaagaatcctcctttagttttattttttaaatctagtggtttttctttttcctttttccttaggtcttaattatttccccctttttgtttgctttgcttttcctagtttagtggatcaatgtaatttaaattgctttttaaacaaacatgtaagggtatacattttcgttgggtgctgtttgactttgttgcacaagttttaaaatcttttttttaatagcttgtattttctaaattattttattgcatcttttgttcacattgctcttactattaattttttatttttattaattaattaatttatttatttaattattagatggagtcttgctctgtagccaggctggagagcagcggcatgatcttggctcactgcaagctccacctcagaggttcatgtcattctcctgcctcagcctcccaagtagctgagactacaggtgcctgccaccatgtccggccttttttgtatttttagtagagatggggtttcaccgtgttagccaggatggtctcgatttcctgacctcatgatccacccaccttgggctctcaaagtcctggaattacaggcatgagccactgcaccctgcccaaaaagctttgtgtttttacagatattagacatgtttcttgtttaagaaaaaaaatcttaacgaaaacgtaggagaataagagaaacatttttccaaaaaagagaaatcattgtgattattttatcttattagaatgttggataatatagtctgcttcattaatcatcaagcatgctatgcattttccatttttataggatctgtatctcagttaaggtaatactggtaatttttgtactgtaatcaaagatgaaaaatataggccaaaatcatggaccttgcatagaagctggataatgaagacagctatggagaaaaacatagatacacacacacggacacacatatatataaagtatacacacatatattttttaaagttttaaagcttttaaagcaaaagccggcccctcttctcttccagagtgggaggcctctcccctctcttagagtgggtggggagagcagttgccatgggcagctttccttgtgagccacaggtccctctggacacactgctttctggccacgccccctttccttttcatctttctcattgaccaatgggcttggagcattaaggccacgcccctattccgcattctactggggccctggttacgcctcctctggctcagtcacacagctgcctggtaggtgactggaggccttgatcggttctcattgagattttgctgctgtgaccccaaccctgcctccctccccaccctgcgatggcagaagaaactcaacacaacaaattggctgcagccaagaaaaaggtaaaaacgcactaggtcatagcccctcaacccagccacagatcccctctgatgacaagacccctgccagagtctatacgactcctgaggcacactggactggtcccccctaccccggtgcctctgggctacccccaccaaagttttgtcagtcagccccaccccttcagcaagcagcccagtccttgccctcgccaatcaccccagggtgactttgggtgggtgagtcctggggcttcccgctccattactgggccctcatctcctgccgccccaagcttgatctccctgggctctttgggctctcatctccaaggagccaggccccaccctcgccagtcatccctgggtgactttggactggtgactcctgggactccctgctgcagactgtgccctcccctcctgctgcctcaaggtcgacctccctgggttctttgtgctggcgtctccaaggagctgggtcccaaccctgtgcttccctcccccatcgtggagcagcgacttggacatggtgctgacatggtccctccccccgaccaggaggagtggaatgttgtgatgtcacagtccacctagtaactgctgttactgcaagactggcctttgatcttacgacccagtcccctaagcgttctcaccccgtttctggttcctctggtcacagcacaaatttccagctggaaggggaatggagactatgggacctaggagcaagaggttccaggctgcctcactcccttacagatgttgacggtgggaaaagcctacacttcccccatgaactcaaaacgttgacagtatctctgggtggcaatgagagaatgcgtttggtttggttttctcccaggcttctactttccagagagattttaacatttttttctgagttctccacctcatattctaattctccatggttctgggaccagactctccttcagtcagtggtctctgaagtgacatttgctcatcttctgtggaatagatcttgggaaactgaacttgacaccttgaatcttcctcatattatctcaaccttgggtactttgagtgccacaggataaatgtgggacatctttctgaagcatcagtttcccttgattctcttgagatcaagagaaaaaacatgaatgtacttagggatgacagtcacataggtttctaagagtataccagacctctctctgaaatgaggcttgggttgtcctctttctgataaattctgatttaagagaaaggctgccttctgccatgaggacacattgatataagagtttgagaggtactggtgcacttcttcacactaacagacgtgtgaggatgtatgactctaaaccacatggcatacagttcctgcctacttaatgtttacttttctacctctgcctctggttttggtccctggcagctgctgattcttggcaaaacctcagagcttggagtcagaagactgagtttcaaagttccagtattgcctttttctttttttttttctagccatgatatcaatccttctcagtcactaaatgagtgtgacaacaccttgtacagttgttggtgtcattaaatcagatggtgtgtaagtgtattttgtaaaaactgtaaaggaggatgtggctgtaggggctgacggttctcatgagtattactgctcttctttccaacagttaaaagaatattggcagaaaaacagccctagagttccagcaggagcgaacaggaacaggaaaacaaatggcagtatccctgagaaagccacttctggtggttgccagccacctagggatgtgagtcttggctgaccaggcttctggggacagggggcccaaggggcagtagagggtaattgttaagattgtggatggactgctgggtactggttaagaattctggctttagccgggtgtggtggcccacgcctgtaatcctagcactttgggaggccaaggcaggcggatcatgaggtcaggagatcgagaccatcctggttaacacggtgaaaccctgtctctactaaaaatacaaaacattagccaagcgtggtggtgtgtgcctgtagtcccagctactcagaaggctgaggcaagagaatggtgtgaacctgggaggtggagcttgcagtagccaagattatgccactgcactccagcctggtgacagagcaagactctgtctcaaagaaaaaaaaaaaaaggaattctgggtttgaatcctgcctctccatctgctctgctagggatatgatttagggcaagttgctagacctcatcgggcctctcttttcacatctgtataatagaggtgttattgtttcacttccatttgtgaagtttaaatgagatttgttattgttgtttttatgttaatccctagtacatggcctgctgtaaacactcaggacacccaggatatggtttgattttcctcatccccagtctcagggggaaaccaggacaatgagaacagccacttgccatcaggagtcactgaaggggccccaggatgggatggtggggagataagaaccatgagagaagttggcacaaaggagttatgggacaaaaggtccaagataggcagaaaagaaaatgttgccagttgatggggaagaaaggaagtcagagggctcagacactgtgggggacagaacatctccatgtgcactctcatctcttgtagtcagcaacaggtttccacagggaaggccctacatcatctgctaccctgaaagatctggaggtaagaggctctgggcggaggtgcagtgacccttcgggtcaaccctccaacctcctcctccaggtgggactgggtgcccctctgccagctgagacagcccacacaccccagccctaatgattgttctctctacctctccccccactcctgctccacctcctcctctctgcatgcacctcagagcccgtgccaagaacgagcagtagtcctggattcaaggtccgtagaaatcagtcaactgaagaacaccatcaaatctctggtaagagtccactggggtcccctgattccacgctgccaatcctgggctccagtttccccttggggccctgaagaaaggggctgggggtccctggtgcctgggacaaatagggagcttgggtgcccaggcctcacctggagggaccccagagcatgcagcatggctcttcttttgctgccctctttgccgactctctcctctccagacacccctgctcgagtccttgctacacacgccctggggttgttgcctcttggggaagtgctagcctgactggttgtcaagggccccgtatttctgccatgactcagtccctaatttgctctttgattctggacaagccacctctcctttttgggctcgtgtttccagaggaggtagtgagtatcaaaggtctctgttagctctcgagtctgagatttaaaggccccctagaacggaaacctcagggctaagggctcctgtctgtccttttccatcctatatctgctgtaaagaaccgtacctggcccatacatgctcagtaaatgtttattgaatgaacccacttctctaaatcacaagctgccagaaggaggggcctttctgaaactccatctctagaggtttatattgctgtcctctcaagagattccagattcagactttgagttctgtggctgtgggcaaaagccaacaaagacccaaatcctctgtccttgggagcttgaggagagtttaccggttcgtgttcccattatgtctgagaactttgcctttaaaatccattcctggcccctgcctaccgcttcctggtctggggaatagagttgagggggccaccctccatcaccttatttgactctccccacagaaacaacagaagaaacaagtggaacatcagctggaagaagtaacgtgatttcgtttcctcgcaacatgactgctgggtttggggggcactcagacatacaggccccagtctcgtctcacccactcccagcctggggatgaaggctcacccttcagattccaccccatccccacagggcccctgataacctggtcccatgggtgggcctgtcctggggcattggtggcattctgggggcatgtctcttgctgtgccatctctgcctccccctggtaagagctctgtcttcctcttcctacaggaaaagaaagcaaacaacaagaaacagaaagccaaaagggtgctagaggtgagtggagggtgtgcagtttcctcctgtcctccggagaaggtttctttccttctctttcagcacttgcttggcttttctcccaaaggttcaaatccagacattgaacatacagaaagaggaactaaatacggacctgtaccacatgaaacgttctctcagatactttgaaggtgggaatctgggcaccctgtcatccttcaacctggcactttgacaggtcttcagggggagtcctttgggccccatctcaactctctcattacagaaaagtccaaggatctggctgtccgcctgcaacattcattgcagcgtaaaggagagttagagagtgttctctctaatgtcatggccacacagaagaagaaggcaaaccaggtgagtccaaccacctgccccatcccctgggagcctggctttgcagatggaggagtgagcctaaaggtcccttctgcaggatggagtgtcctgcccagaaggcagcatggccatttcttgctacttttttgtatggtttttaatggcagcctggggctgagtcagctgctgtgggtgagttgggggtcactgtgtggagtgagcactggacgcagagcttggaggccaagtgcctgccccgcccttacctgtctgtggtcttgggcaagtcctagtcctaggtggggtattgggtacttgtactgtgaaggtacagaagagtacctttagtatgttaccatttctgtagaaagaggaaacgtgtgtgcgtgtgtgtgtgtgtgtgtgtgtgtgtgcatactgtgataatatacataaaacatgtctgcaagggttcataaaaaattcaggagagagcaacaagatggccgggagatacttcccttctgtaccttctgagttttggactatgcaaatgtatcatcctttcaaaaagtgaacaaaagattaattttccccttcctatctgtgcccccatccccagcaagaaaaacgggcttagagaattggatagacctgggtgtttatatcccagctctgcctaagtgaacttaggcaagcacttaacctcaaatactccatgttttttcatctccacaatagagggaatcatagtaactgtctcctatggtggttgcgaggattaaatgggattgttagcacggtacctggtgaagcattccacaaaggttcaaacagtggtaataataacagtaataacaatagcaatattatctgatctctctgggcctctgttagccagctataaactcagtctcattccctgtccgttccaactttactgagttcttttaaaaaccagaccacgggcttggaaatgccttgatctttactgaccgagttgtatattgggcctagccctagcccttttaaggggcactgtgtggaaatgcccaggctctccagattgaaacttctcactcttcaccatccagttgtccagccgcagcaaagcacgtacggagtggaagttagagcagtccatgcgggaggaggcactactgaaagtgcagctgacacaggtgaggttttctgagggagttatgtggaaggaagatgaccccaggtggccaggagcaggtgaggaccagtgacagcccttcctaagttctgtgcccattcttgcagttcaaggagtcatttcaacaagtccaattagaaagagatgagtattctgaacatctaaaaggagagagggcccggtggcagcagaggatgagaaaaatgtcgcaggaggtgagatctgacccttcagcccccccacattagataggtcactggatctttctggtcatctgtaaaatgggaatagtagagccagaggtggtcatgggtctgggctttgtggaggtgggggcagagagggagagggcagcctgtccagcctccagcccctctctccaaggccctttccccttgtgctttgggcagatttgcacattaaagaaagagaagcagcaagatatgcgtcgggtagagaagctggagaggagcttgtccaaactcaaaaaccagatgggtaagatggggctggcatgacctgggagcaggactggcatcagagggctgtgagggtggcttagagtgccccagggaggtgggtggatggaagggctttgaggcagagggaaagagatctgtgccaggagacggcgagtcttgtcatctcaatgagtctcagtgtctcagtgtccccatcagcaaagagggcccattgtcagccacccgcagtgctctttctctgaaagtgctttggaagactggctaccatctgggtgcgaggaatcattagcagtgaggccaagtttgaggagcctgagaggagctgtgcgccaagaggagggtttttcttttccgagaatccagaggcccttattatctgcttcctttgtcagctgaacccttgcccccggagcccccagcagtgccctctgaggtggagctgcagcacctgaggaaggaactagagagagtggcaggagagctccaggcccaggtcaaaaacaatcagcgcataagtctcctgaaccagcgacaagaagagaggattcgggagcaggaagagaggcttcggaagcaggaggagaggattcaggagcagcacaagagccttcagcagctggccaagccacagagcgtcttcaaggagccggtgcgttgcccaaactggggagcttgccctcctccctagacctccgggcctttgtttccccacctctaaaatggggcagtgtagccctcacatgaaatgttacttctaaaggcacctgtgagccaggtggctgtgggagagagggggtgatttttctaacctgcctccagccttcccagtgccatgggaggcagacaccaagttctggggtctccagctgcagtgggtggctgctgattgcttctctctgtccagaacaatgagaacaagaacgcactgcagttggagcagcaagtaaaggagctacaggagaagcttggcgaggtgaaggagacggaaacctccaccccatccaagaagggctgggaggcgggcagcagcctcttgggaggggaggtgccaggccagaggcagcttccagcctgggggctggtgaccacagcaccccccagggcagtcctgtgactgtttcttgcttcctgcctctgacttttaaaggtgggtagccctgggctcctctaaggtctggacatcatcatcccagctagaggcatggagcccccaatcacaggggaagagacagtgctataacaggctccttataccaggtgcagtggctcatgcctataatcccagcactttgggaggctgaggcaggagaatcacttgaggtcgggagtttgagatcagcctggccaatgtggtaaaacctcatctctactaaaattacaaaaaaaaaaaaaaaaaaaaattagcaggacattgtggcgcatgcctgtaattccacctactcgggaggctgaggcacgagaattgcttcaacccaggaggtggaggttgcagtgagctgagattgcaccactgcactccagcctgggccacagagtgacactcttgtctgaaaacaaaacaaaaagactccttagattgaaactggattccagcctcggttccactggtcaccattcaagtactttgcatctctaagtctctgtttctttaacttcaaagggaagttagcattttccttacagaggtgctgaggattaaatgagaagagggtatgagatttgaggctggggaaggaggcatggggttctaggaaagggaggcagtcacttaggcctggagtaaggggacaggggcctgggcagctgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagctgcagcagcaggaagcttggggcaaagcggtggctgagatggcctgccaaaagttgcaggagacccaggggagggagctgccgaggatggggctgtgagggggatgacctggcaaactccaccccttctcactctgtcctggccccttaggagcacctggaagctgccagccagcagaaccagcagctaacggcccagctgagcctcatggctctccctggggaaggtacgggagactgctcagaggaagaggagagagccccaggaggaaggggggactgctagcagcataggattgaggagttggaagagacctttagaacagctggtcattatgccgaccgggtgcctgcactaagttcggcatcagtgtggtgacctcctgtgagcggggggtcaccaagttgcctaaggatggctgaactggccaaggtcagaaagggagcaggtcagaactcccacatcgaccagtagtgggagtgtgcctgggcggaatagcaagatcttgattcttaaaagtaaaaataaagaacaacagctcattcctctctggggaggggcaggctcagggttacacagtgagggtggaggtagaggtgggcccacagtacctcccttgttgggttgtctgaagacccgtctgaccaccccccacaggacacggaggagaacatctggacagtgagggggaggaggcacctcggcccatgccgagtgtcccagaggacccggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggttgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtcctgccagcgcctggctcacccggtggcctcggcccagaaggagccagaggcagccagaggccctggagccccagggcctgggggcgagtctgtgagtggggagacccactgggccctgcaggaagtcacggagaagctggcccatgccaggactcacctccaccttctccatgacttgaaaatgccacctgagggcaggtcgctgccgagatgtgactgcaatattttggctccagagcagctttatggaccacctggaggagaaggcagacctgagtgagctggtgaagaaaaaagaactctgcttcatccaccactggcgagagagatgccatcagtgagtgggaggccagggcacggcagggggagctacagggccgtcggaggggccccagcgtctgagccctgtcctcccgcaggaaaacccatcaccttttatcagaaccagggggccgtgccaaagatgcggcactgggaggaggacaccatcaggctggagctcagggaggagatgaaggtagggtgtgcaacatttctgtgggggtgggggtgggggtgggtgtgagggtgggcgcaggcagcggcatggcagctgagcacccctccctccaggtgaagctgctggagctgcagcagatggtattgcggcttacagcaactacaacaatgggcacagaaaattcctggccgctgcccacaactctgctgatgagcccggtccaggagccccagccccccaggagcttggggctgcagacaagcatggtcgtgagtagagccctcaggtggggtgggcaggcaggaagagggggctcccactgtgctcagatccctgcctccctctctccaaagatctttgtgaggtgagcctcacctcctctgcccaaggagaggccagggaggatcctctccttgacaagcctactgcacagccgatcgtgcaggaccaccaggagcacccaggcttgggcagcaactgctgtgtgccattcttgtgctgggcttggctgccaagaagaaggagataaacatcaccatcctcaaagagctgctcaagaaatttttaaataagaaaccaagttatggggttaatctcctacacaattcatttacttcctttgaatgttagagtcactcatgattatttgtttttctaatttatagttttaagtttatttgtaaaaagttaaaagagagtgggtgtctgtggctctcactgatgttcactctggcatcctttagcatttttcttttttaatttcataattgtaggtcattagcgtgcatatcgagtttgcccttacgtggtgggagttcaaacacacaaagacccactctttgcccaaaactgttctctttggtttggaataggctgccatgcttttttaatgttattgcagcatgtatattcactacagaattcagacaaaatttgcctatgttctgctgttgtttgatctaatcttaatcacagtgagctcttcattagctcaatatgtagtttgcccccaagtgtgcactgtttattactttgtaatatgccactatgagtactgacatttagagttgtttaaaggccaagaactggaaacagcctttcctccattttctgtgtgttggtgatgggagtgataaccttttgggggagctttttaaatctcacagaagaggaaagtggcctcctctggcaggtacgtgcaggatagagtgtgtttcatctgttccggtgcccggaattagcagtgtattatggtggttcccttaggatttgtatgtgctctgggctcatgaagatactgcatcatgagctgcagcagttgtactctttttcgatgacctaaaaagggcttatttctgaggaatgaaaggttcccatcattgactgtggatgtgggaaacctttcctagcttagagcatttgtatctacaatacattttaaagtcagagttcatgttacctgttttaatcacatgactacatgtcccagtacacaaaagggcactggttggcattcttcttaatgtatttagtgaagatcataagaaatcctttatgagttcaaacgttcctggaacaggcatacaggctctagtcaagaatgaattagagtgaaggaaagctgtgtgacacctggcattcctctctgttcacggagattctttgaggcttgaagattgattttaccatctagacctctttggctaatacctattcttcaaccaccttggttactctgacataggaatttacttctttttctttgaatggaaaacactttaaaaaataatagaaacattattataaactaatatatgtgagatacttagttgaaacaaaaaggagttttagtagacggtattgtactctctttgaaaatcaaggagaagtttatgaaacttaaaatgtgtacaaactgcagtgcaatctactgttcgtgaatgtcaatgtattatcaggaaacgtgtctatacaatcacagagttatattttctcacagacttctttacaaagtgaaatatgtttttgtacctctgggtttctgttcgggacatattttgtgcaatatttatgtgattgtgcctatgcatgatgaatgaatacatttcagttatatattgcctaaatcataacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttccactgactcttccaaattttatgaatgtatcaatgtattagataaacccagtttcagaatgataaagaaaaaatttagaccaaataatgcagctaattaacagtggtacgatttgtagcccgtgggtttaaaatgcacttaaagtcctgttctcgccttttattttctgaacttgccgcttttgcattctttgagttcagtttaaagacagttactttaagagcattttaaaccctcgggctagaaatcggaccactgttaatcagccacattatttggtctaacgttttttcttttatcattctgaaactgggtttatctaatacattgataaattattgcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggtatttgtcatatatttaagaaaaagttaaaaagaatggaaattgtatgacaataactcaagtctttctccaaagtgcatgcagtcttttgcgatacctcattcagccgagtatttgtgctcttcctcattcagtataaggcagctttcagtttgcttagaaggcaacattggaatgttagagttcatcagaaacatagaattttaaactgtgagttccactgaatacattttaatgtctgtaggaagaatcaaaacacctatttaaagatggcaatatataataatcattttaaaagtatttgattcaacctgataattttccagaaatgaaaaaaaaaaatcagctctaaaaccaaagctgattttagaaaatttgaaaatgtaaatcagccctatccataatatagtttctctaaaactttattttaaagagtcattttaaaataatataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaagagaatgtgtcgtggaaatactgaaagatttttccctagagtggccttattgactgctggtgtgatgccactgtaatgtaataaattattaagttgtttcaatgtgttgtttttgtcttaaaattttattttgcgtttcttgaaaactatagtattaaaggtattgatactgtgcaaatgctgggcatgcttggcatgagataatgtgtttcatttttacaaagttgtaatataactatgcaagtgtttcttaaaagaacacaagattttaaaagttatgggattaaaaaagttatggggtgaaaaagttatgggataaaaaatgtaaaaacgttgtggcaaaaaaacttgtgggaacaaagtagaaaacagtattatgaaaagttaccaaaaaagttatgaaaaagaagttacgggattcttttttaaaaagtcatggaataaaaataaaaattaaaagcaggcccctgtcagcaaagcctggagaagtggggctggggtctccaccgccaccatgtccctaccaccccttcccaggcacccctttacaattagggtagcaggacaagacctctgtctaatggggaaagacaaacagaccctttgccaccctgaccagggctgagtccctaaatttctggatgatgatgattgttatttaagagccagaggctggtggagttggtttgtttggaggaggcctgatgtcccccttactctcaccatagcaacttttccctcaggggggctcccttcttattcagagaggcaggacagtggggctaactgtggaccaggcgagggcacgggctgctggggtggcccccgttccccggtgtacacattgtgtctgtgtaaggttttgtatattccagagggtagggccacccctgtgtcatacctagctgaggttggagccggcacatggggaggaggttgtaataattatttgtggctgggaaacttatttattgctagcataggacagaggaaggaggcggggatggggtcatggctccctggtgatgcgactcctgtttattttgctttttattttggaataaatggatttagccatactgctcggcctggtgtgtttccgtttccctcactgggtcctggagtttgtgccaccaaacaaggagtcccagagtgtcttgagcatgtccagctaggctgttggggaccttccaggcgtgttacctgtatgctgcctggtggcgcctgggggattccaaggggactgccatgtagtctatggggcgcagtctggccctgacagccaacaggctcagaagcctgatctagcggtggccgggaagacaggtaccagcacctaagggcactgacttccacccagccccggcatcttccgttctatccccttgtctccctctcctgtctgcacctggtggcctgttctgtctgtgcctccagagtgccggctgccctgcaggctccctctgggctgagttcatggccctgccccctggtggccagagccggcttcacaggataagagcccgctaagctccaggggctttccaggaaaagtgtcccttggaaagggcatggccttttcactgctcccaacagcaccctagaaatggcttggcctttcccctcccctgagctccacagagaacacagccagcagaggacacacttccccgccatccagaagcgggtttgattctcagccaagggacagcaggactggtagagactgtcaggccacacagctgcctgcacagcactcccatgcttggtggggggggggggggcgggagggatggcggggtgtgtctctccataggctgggcgtgacagggaggctcactgaaggtagcgcactttggaggggcaatgtcaggggttagctttctcttgtttggccacaagactccaaaaggacagcacggtgactgattcccagcgctagaggcgaggcggttggccacatgtaggtgtgtgtgtgtgtgtgtgtgtgtgtgtgtgtgtgtgtgtatgtatatgggtatttgtagatatttctagaacagggcaggggcataccacagaggggggcacaagttttcagcaacggtcacacctggatgtgtcagctcaccgcaacaatagacgaagtcacagatgaagggggctgcctttggggctgggggagccactgccaagtcacagaacagccgcccaggcaggcttggaaagggaagtctctgagaagaggaggaatctgtttagaggtcaaaggggggcctggggctctcaggatgggatggacttgcctgagccgattggctggcagttggagagaaagcagagagaagacaggagagagaaaagcgagcatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatgtacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgcagggacatggatgaaattggaaatcatcattctcagttaactatcgcaagaacaaaaaaccaaacaccgcatattctcactcataggtgggaattgaacaatgagaacacatggacacaggaaggggaacatcacactctggggactgttgtggggtggggggaggggggagggatagcattgggagatatacccaatgctagatgacgatttagtgggtgcagcgcaccagcatggcacatgtatacatatgtaactaacctgcacattgtcacatgtaccctaaaacttaaagtataataataataataaaaaaaaagcgagcagagagctggtgaggcaagtgcagagcacaggtgtgccacagcagctgtgggagggccaaggagtaaagggtgcacgtgcgggtgtggcaaggttcctggaaaagaggggctggaagggaaaggggaggaagacagagggaggagccggagtttcacaggtagtgcctgggggctgtggcagccctccccaccccacacgtgctggcctcttccacggcacccagtgcacccactgttaagactgatgctcagcccctttgggcttccctcttctctgggcaccgtgtcttccaacccacttgtccagggccacctctcgccttggggagcccaaaacaacagccaccaggcctgatagagaagaaacactgcttgaaccaggatgatgaagctaaaagggatggatgggtggagtgatcgccggagccccctctggggggtcagaaagcccaggaacccttgaagggtccctgggggaggaaaggagggcatgcagctggatgccactggctatagacttataagtctaagaggggagcctcagcttgttgggggttgcaggtcggataggtgaggctgggcccttcctgctgggaaaagcagaagagggagagtctatggcaggggaggtgggtgggcttgtggggcggaggtcagctgggccagcaggcactgtggtccccttggctgaatagcagaggtgacctctaggagcaacactccaaggtgcgtgagcctgctggccagcaatagtgcttcagcgggggccagggaccctgccttcagtcacacgctagcagctatgatggtacctgggagggagggaaggggcctgtgtttcctgcctggcctgtgaggtgtgttgtgggttgaccgtgtgtatgggactctcaaggttttatcctatctcaccactgcattgccgacagatagaggaggtgggactctgactatcacccctgctctgcagtggatttggctctcagcactcccaggctgggagctggatgccctgccctggcagcatgactcagactgcccaacaggtgcggtgtgcacaggaggactatcctaggactctggccgcctcagagtacagccccacacaccaccccctctaagctctcagcccttacaccataaaccacgagctctgtgacggctccagggagcacccatgtctaccagcgtgggcacggagcctgttccaagagtccccaggctcagccatgggggctggggggctttggggccgtgggagccagccttggtacctgcatccggcaaggacgctctgcacctgcaggcaggagttgtccacgggcccccatgtgcgtgctgatggtggtcgtgttgatgtcgccgatgatgccgagtgcctccttcagcacgtggtacatgcgcagcatctcgtcgcgccactgtgcctgctctgccgactcttccatcagcgttttctggtccccacgtgagtacaggttggacagcagctccgagaagatgaactccttggtctgagagcgggcaaagagggaaggaggttgggacctgatgcctttgctgccctggcctcctgccgggccctgctgggactgtgtgctggacttggagccctgagtatggcttttcagacgcggcttctacaccgcttagactcaaagatctgcctccccaccgcccttttctcactcagatagggacactgaggtccaaaggaaaagtcacctgtccaaggtcacacatctgggaggggacccaggacctatcatgccaccaggacaccggtctactcagtttcttaaaaatgttttttggagataggatcttgctctgtcgctaggctggaggacagtgggcgagatcaccactcactgtagcctcaacttcttgggctcaaagtgatcctccaatgtcagcctgtcgagtagctaggactataggtacgtgccaccaccaagcccagctatttttaaaattttagtgtagagatcaggtctcactatgttgcccaagctggtctcgaactcctgggctcaagctatcctcttgccttggcctcccaaagtgctgggattacagacatgggccactgtccccagtcccacgttatatttctatgagacagctctggtctggactgtgcctccctccctggaccttggtcccatagggctggtcagcatctcccccaggccaacatggccacctgcatccccagtgctacaggagccccctgcccctatgaggcggtgcatgcacgttgttgatcatgacgtgcatgatggtcttgggcatgacaccaaccatgaggtcccacacggtcttgttgacaatggccatgtaggagtccacaaggttctgggtggtttccatttgccgctccagctatgggtccatggagtgcatgaagctgtcggagccattctcctcagccttgctgtcctgtcatggagaacacagtggcatcagggtggccaggccatgcagccaggctccaggaatccctaggatctcagcacctccaagggtacctggaacattgaggcacagagaaaaacaactggcgtgaacatgcaccgagctccccacacgctctagacggtttcaggtatctgcctctcaggaccccagactcccctgattcagtctcctcttagttctgactctagtgcccagaatctgcctcaagttaccaatccagaaactggaaaaaaacatctccaggtcccctgttggagacctggccagagcttgtgccaggctgcagacgcctggcagggggcaagaaaggggcatactcactttccccttgtcctgggaggcccatgcaccaacactgccaccgccgccgccaccagggaacacggcaaagtagacacacacagagaggaaaacgggaagggttgagtgaacctgggacactgcaccccaactttaatgtgttgtggaattcagttagctaatattttattgaggatttttgcatcaatattcatcagtgatattggcctgtagttttcttttttggtctgtgtgtttgattttgttatcagggtaatgctagccctgtagaatgagtttgcaagtattccctccttctctatttttggaatcgtttgggtaaggttggtattagttcttctttaaatgtttgctagaattcagcagtgaatcatcaggtcccaggcttttctttgctgggagactttttattaccactttgatcccattatttgttattggtttgttcaggttttgggtttcatcatggttcaatcttggtaggttagatgtgtctggaaatttatccatttttggtaggttttcctatttatttgcacacagttgctgaccactagtgatcctttgaggttttttttcttttctttttttatatggagtcttggtctgtcgcccaggctggagtgcagtggcgcgctctcagctcactgcaagctctgcctcccggtttcacgccattctcctccctcagcctcccaagtagctgggactacaggcgtccgccaccacgccctgctaattttttgtattttttccgtagagacggggttttaccgtgttagccaggatagtcttatctcctgacctcctgatccacccgccttagcctcccaaagtggtgggattacaggcgtgagccacgcccccttgggacagggacacacacacacacacatagacacacacacacacacacacacacacacacacacacacacagagttggttgttgtgccgtccagtcgcgagtgtgaggaagggaccagatcggtcgggcagaaaggtgctgggtcaagagaggagggggcagccggtagcgcgggcacgccgggtgcgcgcggggcgcgccgggttgaggggtgaggggtgaggggtaagaggtgaggggcgacgaggaccggggcggggtaggggcagccctttcccaggcggtagcgggggcagtggtgctgttgcccttttaaactgcggcttgacgggagccgcgcctcctgtcggtggagtcggttataaagggagcagccccgcaggccgccacatagctcccgccaagtcctcggtgccccttgccattttccagccgcgctcccacgagggtcacggcggcggggagaggtggagccgcgagagctcggccgggggccccgcctggtggtcgcggccatgacagcggctcgggactggctccttttccgcgcccctcccgccggaggtgaggggaagatgtccatgtccgggttcaagggcaaaccgaagttactggcctctatcttccaggagaaccaggagccacagccgcggctcacgccccaccgcaacattaaggtgagtcgccgggtggcggcctggcggggcagggcgagggcggaaagcgggtgcccagagtcccaggagaaaggggaagctgccccagagaggccgcggttccccgcccctttctcccgcaactggcccgcccggcaaggcagaggcttgggtgggagaaggcggagggcgcgtctctccaactcctagcgcggggctggcttgggggctgctggcccctctcggcccctgtcgctgcgcctcgaggtgggagcccgcggctgcgggagctctcttgggacccatggtcgccctcagtcagcccacctgctctagggaccgcgacagggcggggcagggcggctcccgcgttgttggagcccaggcggggaaggggaaaggcctttaagattttcggttttttggccgggcgtagtggctcacgcctgtaatcccagcattttgggaggccaaccgggctgatcacttgaggtcatgagttggagaccagcctggccaacatggtgaaacccatctctactaaaaaatagaaaaattagccggtcgtgttggcaggcgacttaatcccagctatttgggaggcagaggcaggagaatcgtttgaacccgggaggcggaggttacagtgagctgagatcgagccattgcactcaaacctgggggagaagagcgagacttctctctctctctctctcaaaaaaaagttttctttctttttttctttttgttgagacagagtctcactcactctgtcgcccaggctggagtgcagtggcgcgatctcggcttactgcagcctacctctcttgacagtccactggttaaagcgattctcctgcgtcagcctcccgagtagctgagattacaggcgcccgccaccacgcctggctaacttttgtgtttttagtagagacggattttttagtagagacgcggtttcaccatgttagccagcatggtcttgatctcctgacctcatgatccacccgcctcagcctcccaaagtgctgggattacaggcgtcagccaccgcgcccgccctctgttttgttttatacatgtaatatattcacaagtatctttacgaagtgattttgatactcttttgtcttctccctagaatctctttgttctgtaataattttttcttagtttatattgatcttattttcctttttaaagcctttccttacatatctattctatgttgcttatcatttgtagtttttttattttttatttatttatttatttatttatttatttatttattttttattttttttttttgagagggagtctcgctctgttacccaggctggagtgcagtggtgcaatctgggctcactgcaagctccgcctcccaggttcacgccattctcctgcctcagcctcctgagtagctgggactacaggcgccagccaccacgccccaacaattttttgtattttttagtagagacggggtttcaccgtgttagccaggatggtctcgatctcctgacctcatgatctggccaccttggcctcccaaagtgctgggattacaggcgtgagccaccgtgcccagccctgattctatattatagtgagttgtacaattatttcattatatgttacaatgtaataataatagaaataaaatgcacaataaatgtaatgtccttgaatcatcccaaaatcatctcccccaaccttgtctgtggaaaaattgtcttctgcaaaactggctcctgatgccaaaaagtttggggactgctggcataagtggtctcatatagtagttgtccttttgtgcctggcttatttcacttagcataatgtctttaacgttcatccatgttgtagcatgtgccagaatttcatttgtttttaaggctgaataatattcccttgtatgtatttaatatgcctttttatcttttcctctgttgatgaatacttgggttgcatccacctattggctattgtgaatagttttgcattgcctgtctttctcatgatcgccatcctatttcgcatctagcaggtgtgaaattccattgattgagtgattgattgagacagggtctgactctgtcgcccagtctggagtgcagtggcatgatcttggctcactgcaacctccatctcccaggctcaagcaattcttctgcctcagccttccgagtagctgggattataggcatgcaccactaccagctggctaatttttgtatttttagtagagacagggtttcaccatgttggccaggctggtctcgaactcctgacctgaaatgatccacctgtctccgcctcccaaagtatttggattacatgtgtgagccactgcgcccagctagtaggtgtgaatttctatgtcttagtggttttgatttgcatttacctgatggcaaatgatgttgagtatcttttcatgtgtttattggccatttgtctgtttttttggggaaatacttattccaaaatttaacttatttttaattgggttatgtatctctttattatttagctgtaagaattttttacatattctagataggagttataacaactttcttcctttttctggattgtcttttttctttcttgatggtgtcctttgaagcagaaagattttaaattttgatatagtccaatttatcttttttcatttgtgtttttttgctccttgtgcttttggtgtaatatctaaaaaaacgttgctactccaaggtcacaaaggtttctgcctatgtttttttctatgagttttatagtttatcaatatctcttatattgagctcttttatccatttgaattaatttttgcatgcggcatgaagtaggggggtatagcttcattgttttgcacctagacatccagttatctcagaactatctgttgaaaagcttattctttccccattgaattgtcttggaacgcttattgaagatcaattgactgtatatgtgaaagtttatttctggattctattcttttctctgttcatctgtccttataccagtagcacactcttgattactgtagctgtttagtaagctttgaaatcagaaagtatgaatcctccagaaagttttttaaggtgggtttggctgttccgggtcacttgcatttccatatgaattttaagatcagcttgtcagtttctgcaaaggagccagctgggattttaatcacagtcgcattgaatatgtagatcaacttagaaagtactgccattttaacaatattaagttttcctccatgaacacaggatgtatttgtactaatttaggtcttcctttaatttctttcaatcgtagttgtgttgaatgcagacctactttgaattaattctaagtaatttttatgctacttattggttgacaaatataattgcttttagtttttaactgtagttttgatgtaatgtgaactgtatttggaccttgtgaagcttatttctgctttgaaatttagtataaattggttataataaaatctgactgtgctaattttttggttatgtgaaatagaaaatcaatgtaaatttaaaaatttattctgggccgggcgcagtggctcacacctgtaatccaagcactgtgggaggctgaggagggcagatcacaaggtcaggagatcaagaccatcctggctaacacagtgaaagcccatctgtactaaaaatacaaaaaattagccgggtgtggtggtgggcacctgtagtcccagctacttgagaggctgaggcaggagaatggtgtgaacctgggaggcggaggttgcggtgagctgagatcgcaccactgcactccagcctgggcgacagagttagactccgtctcaaaaaaaaaaaaaaaaaaaaaaaaattcattctgaaatgcgatagatgttgaagctcttctggcagatggttataaagaggaatatataatcattctattgagaaaatataatcaataatgtgaatacctaaggtagtttattttacatatatatctcggtatttatttatttttgagacagagcctcactcctgtcacccagggtggagtggagtggcacgatcatggctcattgcagcctcaacttcttgggcttaggtgcttatctcatctcatcgcagccacctgagtagctgcgactacaggtgtgcgccaccatgcatggctaattttttgtatttttagtagaggtttccccatgttgtccaggctggtctgaaactcctggactcaagtgatctgcccgcctcggcctcccaaagagctgggattacaggtgtgagccactgtgttggccttatgttttataatttttaaatgatactttttattctattacaaaacatatataattgtaaaaaacttgtaaaatataaaagaggacaaagacagtagaaaaattatttacaatgtaattcccaagtaaacactgattacctttttttttttttttagagcctgttgctcaggctggagtgcagtggcaccatcatagttcactgtaacctcatacatctcatacattttgatattactacttctggttttatacataatgtgttcactttgaagcaagagagtataattttataacgattattttcatttaatgatcgtgatctcattgcaattattgatcatttagtttattcctgaacattttgttttatatatttttgctattgtgagtgggatatttgttataacttggcatttgtgcctacactcaatttacctataggaaactaatttttgcatacaattgttttaattggtgcagtggcacaatctcaactcactgcaacctccgcctcccaggttcaggtgattctcctgcctcagcctcctgagtagctgggattacaggcacatgccaccacacccagctaatttttgtatttttagtagagacagtgtttcaccatgttggtcaggctggtcttgaactcctgacctcgtgatccacccgccttggcctcccaaattgctgggattacaggcttgagccaccgtgcccggcctcggcctctttgtgtgttttcgtatatctttcatctgagttgcaaggggcaccttgggtttccaggaattttcttagctaactctgttcctttatctatgacccttcctcactagttttggataatttattttccttcttccttacttcactgatttacttttctattttatttagtttgctagtcattgtttcttttaaggttcttaagcataaatccttttttttttctgatgggaaatactggggcatagcactaggaatacaaattatgtttaaatagagcacaaagaaccatctcaaaggaataactgatggtgaatgtctggtgattgattttattatgtatcatctctaatgaggcttaataaataattgaggtttaacacttaggtaaccggtctgtatttaagtctgaaaatttttgtatgttacagtttcaacttcacattgaatattctgtaaagcagaaataaattgatcagcattctatgaatgaaaaataaagccatgggtcgggtgcagtggctcacacctataatcccagcactttgggaggccgaggcaggtggatcacctgaggccaggagttcgagaccagcctggccaacatggtgaaaccttgtcctagctactggagaggctgaggcaggagaatgactttaacccaggagacagaggttgtggtgagctgagatcgcgccactgcactctagcctggtgacagagcaagactctgtctcaaaaaaaaaaaaaaaaaaattagctgggcatggtggtgcacacccgtaattccactacttgggaggctgaggcaggagaatcacttgaacccaggaggcagaggttgcagtgagccagggttgcaccactgccctccagcctatgtgacagactgagactccatccctaaaaaaaaaaaaaaaaacaaaaaaaaaccatgctggtaatcgaaaaagcagtttgcctcatcagagtttagaacgttgaattgtaaagatcttttttgtagtcctagccagttttaatggtaacatgagcaattcagttactttctcagagttttatatttttatctgtaaaatggaaattatggtacctacagtttaggatttttgtgaaaatcaagtgagactgcaagtgtcttgaatagcagtggaagtacattgatataggtgatattttacagtggtgtcttcctcagcatcatattagttcagtgttttaaagctctatattagtcacagaaacaaagtcaaatttttgttctcatttcagattacaagtggacacctgagtcagcaggacctggaatcccagatgagagagcttatctacacgactcagatcttgttgtcacccccattattgacaatccaaaggtgcagaaagcactctgacaagtgagttgtagactttactgagatctgaaatctgcataagattttcattcagaatattatttactgtctaatctttcctgtttctcttgtccgctactctttcatttgtgctgcatgtctgcatttccagctcccgctctgtctgcaaccctttcctctgccttcacttccgcttcactggagttctaagttttcccccctctgttttgaatgagtcagctctgcttctcactactgctttcttccacatgccacggaggggttgccagcctcttgacctcagaccttagctctcagtcccatcgtttctccatctgcactaatgtgaatcactctaagtattctagtctctgatgtgttttgaaggcagaagcagtcagagggcactgctcaccaggctgggctgggcaggcagatcacacggaagccctgccctgtcacaggttgttaatactgcaggggagatggtggggagacactatgggaacttgaggagtcatggttcacaatgtacttctaaaccactgtgagtttttttgcttcttgtcttttggaatataatactttattgctgggggataatgagtatttactttaaaaaacagatgcatttctaagtccctctgttttgtcttgacttccagctccccaacatactcacattccactacttattctctattttaactttactgcttcttttacttttttttagttttacttttattttttatttttttgagacagagtcttgctctgtcacacaggctggagtgcaatgacgcgattttggctcactgcaagctccgcctcccaggttcatgtcattctcctgcctcagcctcccaagtagctgggactacaggtgcccgccaccacgccctgctaattttttgtatttttagtagagacagggtttcaccatgtaagccaggatggtctcgatctcctgaccttgtgatccacccacctcggcctctcaaagtgctgggattacaggcatgagccaccacacctggccttctttttcttttttaaatatctttttctgtattaattcatgactgtttttttcttgtctcattgggaacattagtgtggtttagaacaatgtaagggtttttggattcatgtttattttctagatagacagcattttatatagatgatttagctgtttttcataatggagctaattctttttgtgagttcatatgtctggcagtgtaactttattatgctaagtttgatgtgcattggcgcattttcaaaatgggctttctagaacaatttgtgatatctttcccaggggtgtccagtcttttggcttccctgggccacactggaagaagaattgtcttgggccacacataaaatacactaacaatagctgatgaactaaaaaaccaataaaaaaaaattgcaaaaaaattcttacgatgttttaagagagtttatgaatttgtgttgggccatattcaaagccgtcttgggccgcatccagcccacgggctgcgggttggacaagcttgctttacacaatattctgtgtttccttttttcctcttataaccatatttgatagtttatgggaagccttcatcagtggaaatttttgtgtttaacttttaattctaaactacttttagagaaaagattaaaaaatagttgagaactcctgtatagcttttgcccagctgctcttaatgttcacatcttataggtctatagtatagttagcaaaacctgggaattaacattggtatagtgttagtcaggcgggataatccttacctgtgcctccttttggagggcagcagaatgtggtagttggaattgcatgatacttgattcatatctctgtgtaatgatggcatgcaataccctgactgctcctttcgaattcttcctgaaaagggaaaaataaaacatgagaatagtgctgctaactaccaaatgcatttgaattttaccggttgcctctaatgtcctctttttttttgttccaggatcccacattacagttagttgttatgccttcttagtctcatatagtctgtcctagtttttcacggttttgtcagaatttctcagactttgcttgtctttcatgaccttgacagtttgtcttttattttgttttgttttgttttttgtcacccaggctggagtgtagtggcgcgatctcagctcactgcaacctctgccgaccgggttcaagctattctcctgcctcagcctcatgagtagctaggattacaggcacctgccactgcacctggctaagttttgtagttttagtagagatggggttttaccatgttggccaggctggtcttgaactcctgacctcatgatccacctgcctaggcctcccaaagtgctgggattacaggcgtgagccacggcacctggcctttgtatgtttttgtaatacatgttataaaacgtatgactcaagtccttgacactttgaagagtaactggttgggtgttttgaagaatgtcccttaatttaggtttgtctaagggtttctcatgactcgaatgagattatgaatttggattatgagattagaatgagaatatgcattttagtaagaatactacagtaaatacagtaatgctggttacttaattagtaaaggttttaaaaatattacatatagaagttttgcagaagttaggtatagaaatgatggttgaatttttaattaaaagtctcaagatgcagtatctggctgtcctaagctcatggatccaactacatggtttcttcacatttctcaaataaattatgcactttccaattcatgctattatggcttccttgaatggtgtcttctctgatataatcataaagttctagccatccttcaagaccgcaacccaccttctacgtcttccgtaaacccggtgtcaagtatatcaagtaaagtgcttgctgtattctctaaactactatttacaaaaaaaattctttctgtccagggttttgtctgtagttatgtcctgcctcttttgaattgtgaaatattttcttgtttatcaaatgtttgtctcatcttcccaaccagaaagtcagctcgctgaaaataggattgtgtcttttatatctttgtatcccccttagcacttgacatagagccttaccttggcaggtaagcaatagatatttgttgaaagactgaatttctaattagacgtaaattacctaaaaagtaagccaggatggggtgaattttttctttgaagctttattttattacagatatcaattgaaatgattttaaaaaataaattattatctatatatgtatgttttaatctgaaaaggcatcgttctttttgtttttggtaacaaattttacacattctttttttgtcctcattgatttattatctgatataagggacatataaggagacagatatccatctttaaaattgcctcaaaagttttttttttttttaaccacagataaggaaacaaccaccatcggttaaatttgatgcaaaaatattgcatctaccagcattttcaggtaggatcataaaggacttatcgaacatgtagactgtctgtatacagatacgaatatgaaatttattcacaaatggaatatttgtatgtgaacaactaaatttattttgtcttgacaattggttatattcttgggtcagtgttatgtgaattgtaaataatctgtaattcatttgtgccagctgttgacatttctcagctgagtctgggctgccctgtcctcttgtgagtggggaggttcctgtagatctgggcaagttttcctgtagagtgggtggggggcctcctcccttccgttcatagagctggttgaatttccaccatttatggcaggtgtaggtgcacagggttggggacaacaaggaaggattgggattctattggcgggaccaggacatttgagaacgggactaggtggttcatgactgtggagatggtgtgggagtggagatacttaagggataattattacatttctgttgagctaatgaaaatcttatttacggtgaaagtcagaaatttttacataccttaaacttttttttttttaacaaattatattttaagctgttaaactcaatttggggaaaattattcattgtggctagagtagaatctatgatttgaagtaaatttaaaatatatttaggtttaaataaaccagctaagggtttatatcagtcaacttaattagtgataaaaacaaccaaaaaaacctgtgtagaaggacgtttttgaaagaccaaagtgaagcaaaatattaatagtgctttcagtgccaagtaggtctatttatgcaaacctagagaattattatcgggaaatactatttcctttttcttctttgagttacttaggaaattatatttacaatttctttgtctaaagattgagatcagcaaaaacatgttagcaaaaaattttagggagtatcacatttcctagattttgccctttttttatagggatttggaggtaggaatttcaggtgattttagctatcatgttatcctcgttatttttttacagtaatttcattggaactttttaataactgtgtggtttgtgcttttctcaatatctgagagttgatttatttatacaaaggcttttttgtcttttactccagttgtattgaactttgcattttgttataatctaggttgtgagacaattctgctttagacatctgcttggtttgaaagcatagttttccattgaagtgtttaaaaagtttccatggatagataaagagatgaggaatatagaaggacaaatagaagtagtgtcatctttggagtatttttggtgttgacagagtaatgttttctttgtcctcatcttagctgtcgtaactctgtgtttatttctcatgtaatgtttccagcagttgtttttctcatcatcatacttttgttattttctttccttggcaatggataagttataatttctgaaagaccaagattggaatgactttttgtaacaagtgtgctcgcagatcgactccagtgagaagagctcggggacctcctgagccaagcttaatctcctttgctgtttgtgagtggtggctggtcaccaggaggtggccaccaggctcctcctttccccgctggtaggcctctgtgacatgacttatgcatttaaatttatgttttttatagaggctcaaacaagtgctaaaatagcaatttgatttaactaccatgaaaaaactgatttatcacgattttaggtttatgcaaattatcctctgcttaatccttacgtcttaaagtagataagagtagacggtgattttgaactttttgttgttgttgttgtttgtaatactcaggtttccattttatgttaacttgtaagatttttaaaaaatatgtgaaatcaggccgggcgtgatatcataagacagaccttttaccttctcatcagtgactggaatgaacgcctgtaatctcagtactttgggaggccgaggcaggtggatcacctgaggtcagcagtttgaaaccagcctggccaacatggcgaaaccccatctctactaaaaatacaaaattagcagggcgtggtggtgcactcctgtaatcctagctacttgggaggctgagacaggagaatcacttgaacccaggagccagaagtcgcagtgagccgtgatcatgccattgcaccccagcctgggcaaaaagagcgaaaccccatctcaaaaaataaaaacaaaaaacaaacaaaaaaaaatgtgatatcataagacagaccttttcccttctcatcagtgactggaattaactgcccatgtggaacgggttgtgggtgttggttcctttactgggtcatctggtaaactgcaaggtttctgctgtgacattgaaggcagacatcaaccctctaagacatttttttcctatcctctgggaatattactttttggacaatcttggtccattggtaagctcatgggaatttgtcagagtttttttgtttcttttggctcatgtttagcatcgattggcagagtgtttggagtcatcctcagaaaggaattacagtggttcggaggtgttttctgtagtgggccctcatttgggaattggcttgaaaaaaatgtaagttcacttgcttccaggatggtattaagattgctttttttgatagttggcgtgtgtctatcaggtaagggctgtcatttagagaatataaagtggtaggagaaactaaaagtactgttcttagtttttattttaatcttattcgtatacaagtgcctttgtaatttagcaaatatcatttttggtgtacagtataaatttcctttttataaagatctgagtttttaactttgctgtcactttctgtgtttcatgacttaaatattttaattttttctttttttacatttacattttttattctagttccaattgctaatccagcatttgtggatagctgcaaactgcgatatgtaagtaacatttacattttaaaaattatttctcatggttttattaagtagttacagcatacatatttatcaaaagcagagtcctaagtaattatcataaattttcctgatgtaatgatgaatttactcataggcaatttttatgggcattccaattataaactttagaatatttaaaaatagcccttctcctaatatagatacgattctgggattatctaagctactcctggaaactttattaactgttgttgtttttttattttcgtagagacaaggtctctcactatgttgcccaggctggtttccaactcctgggctcaagtgattctcccatctctgactcccaaagtgttaggattacagacgtgagccactgcgccaggctaactgttactgttttgagtattggttataaaatacttcaaccctgatccctgtgtattaatttagttatacttcctcaaagtttcccttgggcacccttatctgtccctatgtagcacatagcttccctatgatgttatttataatctaatgagattaattatgatttataaactcccgatggaaggaagtgtccttactttttatagaagcaacataccaggtggaaagcaccgtagatcaagtgttagaaggctctgggttcctgttgcctataagacttggccaaatgattatctttttctcaatctctgtttcctggggagtgtgggtgggacaaggaaatggcataggtttaggattcagacagacctgggtgtggatcaaagatccgctttctgggccaattactttaattgctgagccgcagtttcctcatctgtaaaattgggatgggataactacttcatagatttttggtaattattcaactttgaatgtggtaaatatgtgagatacctggtatagtgcctgtttctttctttcttttttttttttttctgagtcggcatctccctctgtcacccaggctggagtgcagtggtgcgatctcagctcactgcaagctccgcctcccgggttcacgccgttctcctgcctcagcctccttagtagctgggactacaggcgcccgccaccacgcccgcccggctaatttttttcaccgtggtctcgatctcctgacctcgtgatctgcccacctcagcctcccaaagtgctgggattacaggcatgagccaccgtgactggccgtatagtgcctgattcttagtgggtatttcattgacagtggggttggggttgtagaagttgtagttattatcatgaagcttgcttatctcatgattgttaggacaggcacatgaaaaaacggaggtgaaaggattttgtgaattgtggcagtggtataataattattcttctatgctggtgaaatatgggtgaaacaataggagtttagaaaatgtttaataataagggtaattcttattatacgtcttctaatgttactctcgcaaaataaaatctggtaatagaaagtaggatttttaggtaatggttgagcatttaatactttgagaaggcttatggtatgctcattaaaaatgaatcaatgaaatatgtatctaaacacttttatttaaaacgtgttatatacctgaatggggtgctccctgctgacattttcagacagacattccaaatcatttccgagaacagtcatccctctgtatcagccaggagaatggttctagtatccccttggatactaaaattaacacatactgttttttcccccactgttaaaaattgaggtttgattgtaaaacagttttaatttgaataaaatgatactgaggtagacaagttctctggtaggaatcttcttttattctctttctccatccaaagccacttccagcgaggttttctctgacctcaggttatattaccttgatagcatatgataaagggtccttaacttagtctgggagataattattattgaagtagatacttagttttgttttgcttataaaaaattagaatcacatgatatagttttttatgtttgttttcccccataacatatatattatgtattttaaatgttatcaacattttaaaataaaatacataatacttaaggtaaacgttttatatgttgtgaatatctgatcattttgtttactatttttggatagtattataatgttgtaaacaacattttgatgaacatttttgagattaaatcttcgtgcccgctttttctttttccctttaggaaagattcatagaactagaacaaatgggtagaaggcagtaaatatctttgtgacttctgaaaaattgctgaaatactcttaaaaaaacattgtatcaatagataatcccagtcaatgtgtttaaaatgccttttgttagaacttccaacgttgagtatttatcaaattgtatatccttttatccttgccaatcaactttatgaggtataattcatatatagtaatagtgtaatactgtaactttaaaatgtgttacttgtaaattacacataatttaaaatgttccattttagctatttttatgtgtacagtgacatttagttcattcccattgttgtgtaaccatcaccactattcatttccagaactttttcgtcatcttaaacagaagctctttacccgttaaacataacttcccctttcctttcccttccccagtcctggtaacctatactctacttattctatcttggtaaatttgcttatggtgagtacctcatattgctactgaaacatcgaggggtttggtctaggtcctgttgctcacagcgcagaaagccaatcacggagacgatgagtgttgctagggaacaaggcttcaattgggtgctgcagctaaggagatgggagatcaatctcaaatttgtctcctcgactgactaaaaccacaggtttatttagcagggaagaaatgtaaccatgtatgggaaaacaggagttagggaagggtgagggagaggagttggtcgacaggaagcaggtagttggttaggcaattgtgatgggtgaggtggtctggtgtcttatggtccagatgtggtgatctggtaagtttcagttccttgataactatctgggaggcctgatggttggtttcccaagaaaggaactcagataagacaaatgtaactttctcaagttttaagactgggagggtcaatttctatctttattttaaaagactgtaaacatcagttctataggacaattgggctggtttcatttgcaaggtttatccatgttgtaactaacatgtgtcagcatttcattcctttttaaggctgaataatatccctttgtatgtaatataccacagtttatcttttcatctgttgttgggcactggcttgtttatatcttttggctattgtgaacaatgctgctatgaacattagtgttttcacacctgatgggtatgaagttagtatctcatgggtttgatttgtattttgtgactagtgatgttgaacatctttttttgtgattgttggctatttgtatatcttccttggagaaaggtctagtcaagtcatttgccaatttttttttctttttttgagattgagtctcgctctgtcgcccacgctggagtgcagtggcgtgatctcggctcactgcaacctctgcctcccaggttcaagcgatcattccatctcagcctcccaagtagctgggattacaggcacctgccatcatgcccagcaatttttgtatttttgtagagacgaggtttcaccgtgttggccagatggtcttgaactcctgacctcaggtgatccacccgctttggccccccaaagtgctgggattataggtgtgagccaccgcacccagctggtagattttttgttttgttttgttttcaagaaggcctctcagtggcttacctctgtgccatgctttggagtttgagctgtcttctctttactaactgtagctctgtaggacttgggagtcaaccttaccttcttttttcctccctattttgtaggtcttgtttgagttagcttttctttttattccaggcctgtaaattttactagattgtctctaggaatttcattttactaatttgcttcagcctgcctgcctgccatctctttttactaatttgcttctgcctgcctgcctgcttccttccttccttctttccttccttccttccttaattccttccttccttccttccttcttcccttcctctctctctccctccctcccgtcccttccttcccccctcccgtcccttccttcccttcttttctttccatttattttgagatagagtcttgctctgttgcccaggctggagtgcagtggcgcaatcttggctcactgcaacctccgcctcccgggttcaagcagttctcctgccttagcctcataagtagctgggattacagttgtacgccaccatgcccagcttatttttgtatttttagtttagagatgggttttcaccatgttggccaggctggtctcgaactcctgacctcatgtgatcctcccgccttggcttcccaaagtgctgggattacaggtgtgagccacaatgcccagcctcctcacccctcctttagctattatattacttcctagatttcttcctctctatttcaccctttttctgttcctgaaacccctacaggatgggtgtgggagtttgtgtctcatgactcttctttcaaattttcttttgctttctcactttctcttgtttattgagatataattcacataccataaaattcaccattttaatgtgtacagttcagtaggtgtcagtatattgaaaactgttcaaccattgccactatctaatttgagaacagttttctcacccagtgaaacccagtacccattcttctccaacccctggcaacaactaatctacttcttgtcagctgatttgctattcttgatatttcatataaatggaatcatacagtgtgtggccttttgtgtctagcttctgtcatttagcataatgttttcaaggttcctccgtatggtggaatgtgtgagtacttcattctttttctagctgaataatctttgtatggctattccacattttgcttatgtggtcttgatggacatttggggttgtttccacatttggctattatgaataatggtgctctgaacatttgtccacagggttttgtgtgaacatatacgtttttatttctcctacagtggtgagattgctggataaaatggtaactctgtgttgaaccttttgaagaactgccaaagtctctttgttaaacttttattttaggttcaggggtacacatgcaggtttgttatataggtgaactcatgttatgggggtttgttgtatgaattatttggtcacccaggcactaagcttggtaaggaccaattgttattttttctgatcctctccctcctcccaccctccaccctaaataggcccccgtgtcgattgttccctctttgtgtccatgcaaactttcttcttttattgctcttccttgactttatctttgagctctcaaacttgatatttatccccactcattttattatttaggatttccagttaattttttaatttcaacaatcatatttgaaagtttttgttcattttctttttctctgattggtcctttttcctagctgcctatatttggtatataatatacttttgaatttgaggataaatattaggattataaaaatcctcatcttggagcagaatttagaattaaatattgttattaatatttaaggctaaacattaggattatataatataagcctggaacctggactttgaaaaaaagggaacaaaattaggattatgaacattgtattcttatctcttgaacttgcaggtcacttctttttcatcatggtcctgctttttaatgctgtttatttctcaaatgcctggtgatctctggttcttcatttatattatgaataaatgattaaattgattggtatagaagttggcaatatgagtttcctttattcttgcctaagtctctttctccaatagcttctcctttaaagaaagggctggtatgtgggtaggtgaggcctgttgactggttgactttaatttgggattccagctggctgaagatcagtaggcaggctggaggcctctgcaattgccagggtgggtttttctttgcagtggagctggctttcctcatttattcccttccccgcttcggtatctggaggaccacagttgctgcttcccacatccatccatccagtgagcaaggtggattgctcactgtaggaatgattttccacatttactcaggaggccagggctgcagggtttattctgtgtaccagggaagggagatggaaaagagacaggacctgattggctctgctgttccttgtacaaggacacaatttttccttgtgcagttgtttaatctgattattgtcctgtggctcattctttctttttgtctttgtttattccaagtccctgaggcttccttgggaacgtctgtctacctgtggttcttagacaggggattcctttgttgattctctgtcagtcttaattctatttgtgcatgtcatctgagattttctcaaactttctagtccacttttagccctcctttttgtttccaattatcatttaataaaaagagcttgtattttagagactctggagggttcagaaaagtgagtgtcaagtgttcagtgtgcaatcattaaagacagagaatatctcataagtttgcatctgtgttacttacacgattgtgatttacggatgctttatttctttccctttcccttttatttttccttttgtttcttttatgtatttattattattattatttttagagactcactctaaaaaaaaatagggtctcactgtgttccccagactggaatgggactacaggtacatgccaccatgcctggctaaattaaattttttttttttttttttttttttttagagacagggtctcactttgttggccaggctggtcttgaactcctggccttagtgatccttccatcttgtcctcctaaagtgctggggattacaggtgtgaaccactgtacctggccaaagtttttattttttaatatgatgtataaggtttagaagtgctttattttatttatttatttatttttgagacggagtctcactctgttgcccaggctggagtgcagtggcacgatctcggctcactgaaacctccacctcctgggttcaagcgattctcctgcctcagcctcccaagtagctgggattacaggcgcccaccaccacgcctgactaatttttgtattttttagtagagatggcatttcaccatgttggccaggctggttttgaacttctgacctcaagtaatcagcctgccctggactcccaaagtgctgggattacaggcgtgagccaccatgcccaggagaagtgcttttaactccacacgtgtttaggttttttggtttgtatttgttatttttacttttttccttttactacatcaaaatgagtcctttataatttctgccctagggaattctaataatttttctttgtggtccaatataaaatcatttttaatgtatgccatgaatgtagtcaactattgataataatgtagtactagtagtttgctcagtcagcacaaattgtcaggacacagtggtaatttctgcatgtggattatctcctgattcttagaacaacatgaaaccaggctcatgaaagatgagtaattatcccagggtactgtctccctcacctccaatggtgggccagagctaggtccaagactttgaattctagagtgttagacaccatcctatgcagcctcccactgagtaagggtggtcactgtttgtagggtgtagagtttgatagatacgtctgttactttgacttcattagttttatttagaatgcttgaatgtgtgaatgtattgattaatatattcgttattgccttctctctgtgcttggaagagaagaaaattgaagtttaccactaccatgggtttactttgcgtgctttgttatttggtgtataaagattcacatcttagatcttctgtaggtcatatggtgtttcgtttaaagggaatcttcttctgaagagtttagccttgaattctgctgagatttacattggcaatcctgtttgcattttgtttgccttggacagccatacttttatgcactcctttcctactaatgtgtttattttgcttttgatgttgatatatttgttcaaccaacatttttagatgcccgagtgcgctccaagcactgtctaggtgtcacagtggcgattgggatacagtcctgccttcatggatcttctgggctggtcgaggagacagacaataaaccagtcaatgaatgaataagtaactgcaaaattttagttctgctctaatgtggtagccattcacttcatgggggttatttaaattagttaaattaatagtagcttactcattcagcatgtattgtcggacacaatggtactttctgcacatggattatctcctttgattcttttaacaacatgcggtatgtattgttatcggtcctacttacgaggtaaccaggactaggcacatgaaagatgagtaattaccccagggcactgtctccctcaccctcaactgtgggggtaatttttaaaataaaaattaaggccaaatacagtggctcacgcctataatcccagcactttgggaggctgaggtgggcagatcagttgagctcaggagttcaagaccagcctggacaacatggtgaaaccctgtttttactaaaaatacaaaaattagccaggtgtggtgacacacacctacagtcccggctacttgggaggctgaattgggaggattacttgagcccgggaggcattgcagtgagcggagactgcgccactgctctctagcttggatgaccctgtcttccaaaaaaaaaaaaaaaaattaatttgaataaaatttgttgttcctcacttgcatgtgtcatatattatgtgcttgatagtcatgtgtctagtggatactggattgaacagtgcagatgtgggacatttgtcagtgcacgaaggtttggtagacagtggtgccttagatgccgtcatggagatgggttggttctgaggtacagtgtcaagtcactgggggcacctggagtggtgacctgagaaaacctgaattttgagaaggaacctgtactgtgagggtgttgtctatggggcatgtggtacttgtatttaggattttggtaaaaagtgactattcataagctatttaaagtttctattttaaaagtatagggtttttaggtagtgtgttttcttttgttctaataggaattgttttggtcatattagggaaaataattggcttgttgatacatttttatttccattgattaaatctggtagccattatttacttttatagattgaaaaatggttcagtgtttcaaaagtattttgagcttgtctttgaaaagagatagacaggcaggtgcagtggctcagacctgtaatcgcagcagtttgggaggctgagatgggaggattgtttgtcaggagctcaaggccagcctgggcatcatagcgagaccccatctctacaaaaagtaaaaaaattagctgagcgtggtggtgcacgcctgtagtcccagctacttggggggttgtggtgggaggatggcttttccaattatcctacagatatttttcaaaatgattacttttaaactataatctttttattcagaggtaggatgctagttctacaattgcctaggtcttctttaatttgtatatgttaagaaattttaatgggcaatttaataagtgttgaaatttctaagaattatttctgtatgttagagttgtgataacgcagacattttccctgaagtacttctctgagtctgatttgttttcctccatgggtgccacataggtttcttttaagaaggtaaaaaataaaagctgactaaggtacatattgattattccagacaacatgcagacatcactcaatgagtgcagttctcatcaactcaccatttgtttcaattagaaaaaattctcatcaaaactaatttttctgcatgaaataccttttcaaatcacactgaatgtgatttattaattgtgatttatcaaattcagttttctgctggatactaaaggcacacctcattaagactagtgattatggaaatagtacaatattttagaaacttttgattgtaaaaatttcttttaaaatgaatacatacagatatgttattgttcagatatttaacacttacgtagaaactcactgatctactaacaagtagaaaagagacctttagccaaatgcctctgtactcagcaataaaatgattaattactgtgttgctcttttctctggttaaggcttttaacaaattttgtttttccttttactattacaccataacttgtttaaattttgttgctgttgcagaattacagcagacattacagttcatgtctccctgtgtatacgagggagagtttctctgggctgtgtacatgggggagtgtgggcctgacctgtcacattcaatttttatttcacagtcttatatctaatgctcatcattgcataatgtaactagctggggttagtttcctcagtccctgactcttctcttcagagcctgttttctctccgtttacagatgggccaaggttgctcgggtgattggtttactggcttcgcacaaaactgatctccaggaaaatacacctgttgttgaggtaatgtcttttatgactgaaatgtgatgaatgacaagaaatactgttgttgattctgtaatttagaacatgtggctttccttgaccttcacttgacttttctttgtgggattgtggaaattgttcaaaaacttatcacctcaacagacctttaggcttaaacatagcggctcatttacaatgtagtccatcattaaaatggcacagcagagttaacaaggctcgtgaaccctactcatcattatttcatttgtttttgaataagacttgttcatttcccgttttcttgtagtctgtccaacattttgttacagctaatgtatttcctaattaaatcatagcttataattcaaaattcaaattcttctggcttttagtgttttcgtatgaaagattactttctacctattctgttaatgtatattacactttattggtaatagagtgttataccttgaactgggagaggctcaagagtcagtgtaggtgaaaagaaccaaggctttttaggggaaatagcaagaggtcctgaaggaagttaaaaagggtaagggagagaggattttgtagagctgaagctggttgtgtggtatttggggctttaagaggaattggaaaactttctatgtctgtgttgtccactatagtagccaattggtatttggagcctcaagaggaattggaaacttttctctctgtgccattcactgcagtagccaattgctgggatagtataccagctggccttacagtgtctgggtggagattaatataatttcactgtatttcccttgcttacaattacatctctatttcctgcaaactgttggatctctgagctactagtaaaatgccactaagtctaattgtttccttttttggggggcctaaaataaatgaattgtgacctgtgtgattactgatggtacccaacttggttctcagagatgtgtcgagtagatttttatctaaaagattgagcatatagggcagtattaccaggaagatgagaaggcttaggatcttaaaaatgggggttccttctgatggctcagagcaaaaggtctccagtgagatggagtagctgtagaagatgggagagaacataaagtccaagacaaagtcccaagattttagaggatattcatgcatcgtcagagcaggcatttgttgctcagaagctgtgaagaaagagcctctgaatatgtaaaatatgactgttgaattaaatgattcagtagttgcagtagattatggatactttaggaagctgagttagtgaatttgaagatcagttggatgaattctcttaggattcagaaagaaagaggataaagattgtgaattaaaaaggcatggatgatagtttcagatgtgttccactatccagtatagtagccaccagccactgtggctattgagtgcttgaagaacagctagtctgaattgagatgatcaacttatagaaaagaatactatgggcaccctgtaatttccaaaccccttgttctacttgatctttttcacagcatatatcaccacctggcattttatgtatttatttctctttccatactagactacaagctccattggaacagggattgtgaattgtcttgttcaacactccacccccgtgcctagacagtgtcttgtgtatatctagatactgacaaatattttgaaataagtgaatgaaagtgtatcagtatgcttgggactccctgtagcagtgcctggaagatggtatgttttgctgctgcaggaattctcaagggactgggcagagggcatgtgaagtaatctgggacctgcttgtcaccctgggtgatgtgctgcccttgttctactggtacttgctgttgcggctgctgcactcccacttggagagtttggcccagcagttcctggaccatatttgttacttgtgctcactcaggttgagttctgtggccagtttgtattctcaaagtatttctgctactccagttatactttgtcaacgttgtattcctggtcctgcctcaactgagaggaaagggtgggtgttaattcccgaggttcttgtatctttgattccggtactgttctcttcatgggtgtttgctgatgctttattaatttgaaatgcaagaccttagggaaaatcatacttatttcatttaaaaaatggtgtgtactgaactatctggtgaactgttttgaattacacacactgtattgtgaactacatttggttggatagtagggagcttatataataacttgaaattgagccaggtgctcctttgtgatgccatcttaattttattatttctccacaccttttagttctttagttcgttacttttaatggcaaaatctgtgaatttcttttacatcaacctatttcctgctgtgagcaattggctgtgataatttaaggagccactagaggtcattcaagcactagaaaaaaagttgtgcaagttttaagaatttgtttcaacttctggaagcaggatctgtagaggctgagcaggtacatggtaccacgtttcatctttttcctggttttttagaagtttctgctacaggatgtgtggctccattccactggtgatttttaccatttgagaggaatcagatgaatgaaaaccattatagcctctccagaaaaatgcagtcagcacctagcacatgatttcaggggatctgaaaactctgcggagtccactggtgaatctttggttcataactcctgagaccaggtttctgtaaaactcacaattgggtgcttgtagataatttttcagtaatcagtaacaaaatttcaagtgtaagataaatcctgaattctctattagatttactatcagtgaacaagaaaaattgtggttgaagttcctgtaagcattttattttttattttacttatttattcatttattttttgagacagagtctcgctctgttgcccaggctgtagtgcagtggtgtgatctcggctcactgcaacctctgtttcccaggttcaagagattctcagcctcagccccagccccacaagtagctgggactgcaggttcatgccaccatgccccgctaacttttgtatttttagtagagacagggtttcaccatattggccaggctggtcttgaactcctggcttcaagtgatccacttgccttggcctcccaaagtgctgggattacaggtgtgagccactgcaccagcctggtactttctaatattttggatgctttcttacttgctaagcactttctcttacctggaatgttttttacattaccccctcccccagtgatctaatttctactttctctttaaagcccagctaacattccattttctccatcaggccttccctaacagtcccagaactcctacattgcctggtgtgctgacctaaagccctcattaagaccagtaacaaatcaagcctatcttatcaactgacaacacattctggaaccatggcgtgtccatggataagacatgaagtccttctttcaagacttggttttctggtcctggaaaataccaatatggataaaagaccttcaaagctgctacgatgggtaaggaacaatgcacacagtataccattaaggcaaagaagatagtcttaatcctgtatgaaatgccaatgaagatgtaattaatgaatagacatttcattgaaatgaaatcaaaagacattttccttctctgacataacagagtagaactctctagtaagaacacaaaactgaccagcctgaccaatgtgataaaaccccctgtctctactaaaaagacaaaaattagccatgcatggtagcagatgcttgtaatcccagctactcaagaggctcaggcatgagaatctcttgaacccaaaaggtggaggctgcagtgagtcgagatcgcacaactgcacttcaccctgggcgacaaagcaagactttgttttttaaaaaaaagaagaagaagagaaaaagaaaaagaacacaaaactctggttactgctctatgagaattaagtgaatgtgaaggagaagttggaataatattacaagttggtgaaatattggaattctggtctgttggtgattggtcttcatctttcctataagagatagctcattacacaatgtattctcatttgtctgaacgggattatttcccttaaggcgatggcctcttctgcatctttatgtctctaatgtctagcatgggaactactcaatatatatttcaggttgttgacaatgattgctgctgtctattccatctaggtaagggtttttgcattcaaaaggccctttgccttaagacctaaagaggttttggaacatcagcaagcatccatctcgaggtaaataactggaatcccaatgggctgtgtgtgtgtgtctgtgtgtgtgtgtgtgcgtgctaactggaatcccagtggggtttgtgtgtgtgtgtgtgtgtgtgtgtgtgtgctaaatggaatcccaatggggttttgtgtgtgtgtgtgtgtgtgcgctcatgcctgcatacacatgcgtgcacttctggtacattttgaacaggcatcagattatgttcccacagcccctcttcatcaaaatgaagaccttgtacgtctgaaatacagtttgtgaaagtcaaattgttatccctgtgacatagaacagccgttaaaaatgtatttcactggaatgtcattctaaatgaatatttttaaatagatatccaaaaataagaaaatacagtgattttagtgtaataaaactgatttcacaattgtttcaagaaactcggaaaataaaacttcaaactggaaaaatgtggccataagaatgcatggagccggacgcggtggctcatgcctgtaatcccagcactttgggaggccgaggcggacagatcacgaggtcaggagatcgagaccatcttggctaacacgaggaaaccgcgtctctactaaaaaatacaaaaaattagctgggcgtggtggtgggcgcctgtagtcccagctactcgggaggctgaggcaggagaatggcgtgaacctgggaggcggagcttgcagtgagccgagattgagccaccgcactccagcctgggcaaaagaggaagactccgtctcaaaaaaaacaaaaacaaaaacaaaaaaagaatgcatggagttagttcattcttctcgccccctggaacttctgatcaaaagtcaatacctttgtgacctacaagtctctttatttgccctccattatagactgagctgttaataacatttaatgagctcacatggattcactggctaataaagaagaatagagttgaggacattgctgccctgtttatgcccaaaaattaccctaaactgaaagttgctttgtgttccttcactcccctctgctggtaaattttaatatagttcttaatttttttaagtcaaattgatagaaacatcaattgtgtttttaaaactgtaagaaaaaataatgttgaacatcacaaaaatgtactcaatctttcccaaaacccatttctttccagttagttttcataactgtaggttcttaaaaaaaaaaaaatgaacactttggccgggtgcgatggctcatgcctgtaatcccagcactttgggaggccgaggcgggtggatcacgaggtcaggagatcgagaccatcctggctaacatggtgaaaccccgtctctactaagccaaaatacaaaaaatcagccaggcgtggtggcgggcgcctgtagtcccagctactcgggaggttgaggcaggagaatgttgtgaacccgggaggcggagcttgcagtgagccaagatcacgccactgcactccagcgtgggtgacagagcaagactccgtctcaaaaaaaaaaaaaaaaaatgaacatgtcatccatacttctaaggtgttgtaaagatgtgtaaagttttcactttttgcatcatattcacatgtggctatatgcccttttctcttcaaagttttctttatcttgattacttatcagaggcttgactgttttattatctcagtcttttgaaagaatcctccttcagttttattttttaaatctagtggtttttctttttcctttttccttatgtcttaattatttccccctttttgtttgttttgcttttcccagtttagtggatcaatgtaatttaaattgctttttaaacaaacatgtaagggtatacattttcgttgggtgctgtttgactttgttgcacaagttttaaaatctattttttaatagtttgtattttctaaattattttattacaacttttgttcacattgctcttactattaattttttatttttattaattaattaattaatttatttatttattgagatggagtcttgctctgtagccaggctggagtgcagcggcatgatcttggctcactgcaagctccacctcgggggttcatgtcattctcctgcctcagcctcccaagtagctgagactacagttgcctgccaccacatccggccttttttgtatttttagtagagatgggatttcaccgtgttagccaggatggtctcgatctcctgacctcatgatccacccaccttgggctctcaaagtcctggaattacaggcatgagccactgcacccggcccaaaagctttgtgtttttacagatattagacatgtttcttgtttaagaaaaaaaaatcttaatgaaaacgtaggagaataaaagaaacatttttccaaaaaagagaaatcattgtgattattttatcttattagaatgttggataatatagtctgcttcattaatcatcaagcatgctatgcattttccatttttataggatctgtatctcagttaaggtaatactggtaatttttgtactgtaatcaaagatgaagaatataggccaaaatcatagaccttgcatagaagctggataatgaagacagctatggagaaaaacatagatacacacacacggacacacatatatataaagtatacacacatatattttttaaagttttaaagcttttaaagcaaaagccggcccctcttctcttccagagtgggaggcctctcccctctcttagagtgggtggggagagcagttgccatgggcagctttccttgtgagccacaggtccctctggacacactgctttctggccacgccccctttccttttcatctttctcattgaccaatgggcttggagcattaaggccacgcccctattccgcattctactggggccctggttacgcctcctctggctcagtcacacagctgcctggtaggtgactggaggccttgatcggttctcattgagattttgctgctgtgaccccaaccctgcctccctccccaccctgcgatggcagaagaaactcaacacaacaaattggctgcagccaagaaaaaggtaaaaacgcactaggtcatagcccctcaacccagccacagatcccctctgatgacaagacccctgccagagtctatacgactcctgaggcacactggactggtcccccctaccccggtgcctctgggctacccccaccaaagttttgtcagtcagccccaccccttcagcaagcagcccagtccttgccctcgccaatcaccccagggtgactttgggtgggtgagtcctggggcttcccgctccattactgggccctcatctcctgccgccccaagcttgatctccctgggctctttgggctctcatctccaaggagccaggccccaccctcgccagtcatccctgggtgactttggactggtgactcctgggactccctgctgcagactgtgccctcccctcctgctgcctcaaggtcgacctccctgggttctttgtgctggcgtctccaaggagctgggtcccaaccctgtgcttccctcccccatcgtggagcagcgacttggacatggtgctgacatggtccctccccccgaccaggaggagtggaatgttgtgatgtcacagtccacctagtaactgctgttactgcaagactggcctttgatcttacgacccagtcccctaagcgttctcaccccgtttctggttcctctggtcacagcacaaatttccagctggaaggggaatggagactatgggacctaggagcaagaggttccaggctgcctcactcccttacagatgttgacggtgggaaaagcctacacttcccccatgaactcaaaacgttgacagtatctctgggtggcaatgagagaatgggtttggtttggttttctcccaggcttctactttccagagagattttaacatttttttctgagttctccacctcatattctaattctccatggttctgggaccagactctccttcagtcagtggtctctgaagtgacatttgctcatcttctgtggaatagatcttgggaaactgaacttgacaccttgaatcttcctcatattatctcaaccttgggtactttgagtgccacaggataaatatgggacatctttctgaagcatcagtttcccttgattctcttgagatcaagagaaaaaacatgaatgtacttagggatgacagtcacataggtttctaagagtataccagacctctctctgaaatgaggcttgggttgtcctctttctgataaattctgatttaagagaaaggctgccttctgccatgaggacacattgatataagagtttgagaggtactggtgcacttcttcacactaacagacgtgtgaggatgtgtgactctaaaccacatggcatacagttcctgcctacttaatgtttacttttctacctctgcctctggttttggtccctggcagctgctgattcttggcaaaacctcagagcttggagtcagaagactgagtttcaaagttccagtattgcctttttcttttttttttctagccatgatatcaatccttctcagtcactaaatgagtgtgacaacaccttgtacagttgttggtgtcattaaatcagatggtgtgtaagtgtattttgtaaaaactgtaaaggaggatgtggctgtaggggctgacggttctcatgagtattactgctcttctttccaacagttaaaagaatattggcagaaaaacagccctagagttccagcaggagcgaacaggaacaggaaaacaaatggcagtatccctgagaaagccacttctggtggttgccagccacctagggatgtgagtcttggctgaccaggcttctggggacagggggcccaaggggcaatagagggtaattcttaagattgtggatggactgctgggtactggttaagaattctggctttagccgggtgtggtggcccacgcctgtaatcctagcactttgggaggccaaggcaggcggatcatgaggtcaggagatcgagaccatcctggttaacacggtgaaaccctgtctctactaaaaatacaaaaacattagccaagcgtggtggcgtgtgcctgtagtcccagctactcagaaggctgaggcaagagaatggtgtgaacctgggaggtggagcttgcagtagccaagattatgccactgcactccagcctggtgacagagcaagactctgtctcaaagaaaaaaaaaaaaaaaggaattctgggtttgaatcctgcctctccatctgctctgctagggatatgatttagggcaagttgctagacctcatcgggcctctcttttcacatctgtataatagaggtgttattgtttcacttccatttgtgaagtttaaatgagatttgttattgttgtttttatgttaatccctagtacatggcctgctgtaaacactcagaacacccaggatatggtttgattttcctcatccccagtctcagggggaaaccaggacaatgagaacagccacttgccatcaggagtcactgaaggggccccaggatgggatggtggggagataagaaccatgagagaagttggcacaaaggagttatgggacaaaaggtccaagataggcagaaaagaaaatgttgccagttgatggggaagaaaggaagtcagagggctcagacactgtgggggacagaacatctccatgtgcactctcatctcttgtagtcagcaacaggtttccacagggaaggccctacatcatctgctaccctgaaagatctggaggtaagaggctctgggcggaggtgcagtgacccttcgggtcaaccctccaacctcctcctccaggtgggactgggtgcccctctgccagctgagacagcccacacaccccagccctaatgattgttctctctacctctccccccactcctgctccacctcctcctctctgcatgcacctcagagcccgtgccaagaacgagcagtagtcctggattcaaggtccgtagaaatcagtcaactgaagaacaccatcaaatctctggtaagagtccactggggtcccctgattccacgctgccaatcctgggctccagtttccccttggggccctgaagaaaggggctgggggtccctggtgcctgggacaaatagggagcttgggtgcccaggcctcacctggagggaccccagagcatgcagcatggctcttcttttgctgccctctttgccgactctctcctctccagacacccctgctcgagtccttgctacacacgccctggggttgttgcctcttggggaagtgctagcctgactggttgtcaagggccccgtatttctgccatgactcagtccctaatttgctctttgattctggacaagccacctctcctttttgggctcgtgtttccagaggaggtagtgagtatcaaaggtctctgttagctctcgagtctgagatttaaaggccccctagaacggaaacctcagggctaagggctcctgtctgtccttttccatcctatatctgctgtaaagaaccgtacctggcccatacatgctcagtaaatgtttattgaatgaacccacttctctaaatcacaagctgccagaaggaggggcctttctgaaactccatctctagaggtttatattgctgtcctctcaagagattccagattcagactttgagttctgtggctgtgggcaaaagccaacaaagacccaaatcctctgtccttgggagcttgaggagagtttaccggttcgtgttcccattatgtctgagaactttgcctttaaaatccattcctggcccctgcctaccgcttcctggtctggggaatagagttgagggggccaccctcccatccaccttatttgactctccccacagaaacaacagaagaaacaagtggaacatcagctggaagaagtaacgtgatttcgtttcctcgcaacatgactgctgggtttggggggcactcagacatacaggccccagtctcgtctcacccactcccagcctggggatgaaggctcacccttcagattccaccccatccccacagggcccctgataacctggtcccatgggtgggcctgtcctggggcattggtggcattctgggggcatgtctcttgctgtgccatctctgcctccccctggtaagagctctgtcttcctcttcctacaggaaaagaaagcaaacaacaagaaacagaaagccaaaagggtgctagaggtgagtggagggtgtgcagtttcctcctgtcctccggagaaggtttctttccttctctttcagcacttgcttggcttttctcccaaaggttcaaatccagacattgaacatacagaaagaggaactaaatacggacctgtaccacatgaaacgttctctcagatactttgaaggtgggaatctgggcaccctgtcatccttcaacctggcactttgacaggtcttcagggggagtcctttgggccccatctcaactctctcattacagaaaagtccaaggatctggctgtccgcctgcaacattcattgcagcgtaaaggagagttagagagtgttctctctaatgtcatggccacacagaagaagaaggcaaaccaggtgagtccaaccacctgccccatcccctgggagcctggctttgcagatggaggagtgagcctaaaggtcccttctgcaggatggagtgtcctgcccagaaggcagcatggccatttcttgctacttttttgtatggtttttagtggcagcctggggctgagtcagctgctgtgggtgagttgggggtcactgtgtggagtgagcactggacgcagagcttggaggccaagtgcctgccccgcccttacctggctgtggtcttgggcaagtcctagtcctaggtggggtattgggtacttgtactgtgaaggtacagaagagtacctttagtatgttaccatttctgtagaaagaggaaacgtgtgtgcgtgtgtgtgtgtgtgtgtgtgtgtgtgtgcatactgtgataatatacataaaacatgtctgcaagggttcataaaaaagtcaggagagagcaacaagatggccgggagatacttcccttctgtaccttctgagttttggactatgcaaatgtatcatcctttcaaaaagtgaacaaaagattaattttccccttcctatctgtgcccccatccccagcaagaaaaacgggcttagagaattggatagacctgggtgtttatatcccagctctgcctaagtgaacttaggcaagcacttaacctcaaatactccatgttttttcatctccacaatagagggaatcatagtaactgtctcctatggtggttgcgaggattaaatgggattgttagcacggtacctggtgaagcattccacaaaggttcaaacagtggtaataataacagtaataacaatagcaatattatctgatctctctgggcctctgttagccagctataaattcaatctcattccctgtccgttccaactttactgagttcttttaaaaaccagaccacgggcttggaaatgccttgatctttactgaccgagttgtatattgggcctagccctagcccttttaaggggcactgtgtggaaatgcccaggctctccagattgaaacttctcactcttcaccatccagttgtccagccgcagcaaagcacgtacggagtggaagttagagcagtccatgcgggaggagacactactgaaagtgcagctgacacaggtgaggttttctgagggagttatgtggaaggaagatgaccccaggtggccaggagcaggtgaggaccagtgacagcccttcctaagttctgtgcccattcttgcagttgaaggagtcatttcaacaagtccaattagaaagagatgagtattctgaacatctaaaaggagagagggcccggtggcagcagaggatgagaaaaatgtcgcaggaggtgagatctgacccttcagcccccccacattagataggtcactggatctttctggtcatctgtaaaatgggaatagtagagccagaggtggtcatgggtctgggctttgtggaggtgggggcagagagggagagggcagcctgtccagccaccagcccctctctccaaggccctttccccttgtgctttgggcagatttgcacattaaagaaagagaagcagcaagatatgcgtcgggtagaggagctggagaggagcttgtccaaactcaaaaaccagatgggtaagatggggctggcatgacctaggagcaggactggcatcagagggctgtgagggtggcttagagtgccccagggaggtgggtggatggaagggctttgaggcagagggaaagagatctgtgccaggagacggcgagtcttgtcatctcaatgagtctcagtgtctcagtgtccccatcaggaaagagggcccgttgtcagccacccgcagtgctctttctctgaaagtgctttggaagactggctaccatctgggtgcgaggaatcattagcagtgaggccaagtttgaggagcctgagaggagctgtgcgccaagaggagggtttttcttttccgagaatccagaggcccttattatctgcttcctttgtcagctgaacccttgcccccggagcccccagcagtgccctctgaggtggagctgcagcacctgaggaaggaactagagagagtggcaggagagctccaggcccaggtcaaaaagaatcagcgcataagtctcctgaaccagcgacaagaagagaggattcaggagcaggaagagaggcttcggaagcaggaggagaggattcaggagcagcacaagagccttcagcagctggccaagccacagagcgtcttcgaggagccggtgcgttgcccaaactggggagcttgccctcctccctagccctccgggcctttgtttccccacctctaaaatggggcagtgtagccctcacatgaaatgttacttctaaaggcacctgtgagccaggtggctgtgggagagagggagtgatttttctaacctgcctccagccttcccagtgccatgggaggcagacaccaagttctggggtctccagctgcagtgggtggctgctgattgcttctctctgtccagaacaatgagaacaagaacgcactgcagttggagcagcaagtaaaggagctacaggagaagcttggcgaggtgaaggagacggaaacctccaccccatccaagaagggctgggaggcgggcagcagactctggggaggggaggtacgaggccagaggcagcttccagcctgggggctggtgaccacagcaccccccagggcagtcctgtttcttgcttcctgcctctgacttttaaaggtgggtagccctgggatcctctcaggtctggacatcatcatcctagctagaggcatggagcccccaatcacaggggaagagacagtggtataacaggctccttatgccaggtgcagtggctcatgcctataatcccagcactttgggaggctgaggcaggagaatcacttgaggtcgggagtttgggatcagcctggccaatgtggtaaaacctcatctctactaaaattacaaaaaaaaaaaaaaaaattagcaggacattgtggcgcatgcctgtaattccacctactcgggaggctgaggcacgagaattgcttcaacccaggaggtggaggttgcagtgagctgagattgcaccactgcactccagcctgggccacagagtgacactcttgtctgaaaacaaaacaaaaagactccttagattaaaactggattccagcctcggttgcactggtcaccattcaagtactttgcatctctaagtctctgtttctttaacttcaaagggaagttagcattttccttacagaggtgctgaggattaaatgagaagagggtatgagatttgaggctggggaaggaggcatggggttctaggaaagggaggcagtcacttaggcctggagtaaggggacaggggcctgggcagctgacagagccccacagtgccctcgctaccctattaatgggcccagaatctggaaaccagccaccacgtgccctcacacccagggtcttcctgcaggtggagctgaagagccaagaggctcagagtctgcagcagcagccagaccattacctgggtcacctgcagcagtacgtggccacctatcagcagctgacctgttagaaggaggcgctgtacaggcagtgactgcaacagacccagctaatgaaccagctgcagcagcaggaagcttggggcaaagcggtggctgagatggcctgccaaaagttgcaggagacccaggggagggagctgccgaggatggggctgtgagggggatgacctggcaaactccaccccttctcactctgtcctggcccctcaggagcacctggaagctgccagccagcagaaccagcagctaacggcccagctgagcctcatggctctccctggggaaggtacgggagactgctcagaggaagaggagagagccccaggaggaaggggggactgctagcagcataggattgaggagttggaagagacctttagaacagctggtcattatgccgaccgggtgcctgcactaagttcggcatcagtgtggtgacctcctgtgagcggggggtcaccaagttgcctaaggatggctgaactggccaaggtcagaaagggagcaggtcagaactcccacatcgaccagtagtgggagtgtgcctgggcggaatagcaagatcttgattcttaaaagtaaaaataaagaacaacagctcattcctctctggggaggggctggctcagggttacacagtgagggtggaggtagaggtgggcccacagtacctcccttgttgggttgtctgaagacccctctggccaccccccacaggacacggaggagaacatctggacagtgagggggaggaggcacctcagcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtggccaacaggtgcactctctgaggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagccagaggccctggagccccagggcctgggggcgagtctgtgagtagggagacccactgggccctgcaggaagtcacggagaagctggcccatgccaggactcacctccaccttctccatgacttgaaaatgccacctgagggcaggtcgctgccgagatgtgactgcaatattttggctccagagcagctttatggaccacctgaaggagaaggcagacctgagtgagctggtgaaaaaagaactctgcttcatccaccactggcgagacagacgccatcagtgagtgggaggccagggcacggcagggggagctacagggccgtcggaggggccccagcgtctgagccctgtcctcccgcaggaaaacccatcaccttttatcagaaccagggggctgtgccaaagatgcggcactgggaggaggacaccatcaggctggagctcagggaggagatgaaggtagggtgtgcaacatctctgtgggggtgggggtgggggtgggtgtgagggtgggcgcaagcagcggcatggcagctgagcacccctccctccaggtgaagctgctggagctgcagcagatggtattgcggcttacagcaactacaacaatgggcacagaaaattcctggccgctgcccacaaccctgctgatgagcccggtccaggagccccagctccccaggagcttggggctgcagacaagcatggtggtgagtagagccctcaggtggggtgggcaggcaggaagagggggctcccactgtgctcagatccctgcctccctctctccaaagatcttcgtgaggtgagcctcacctcctctgcccaaggagaggccagggaggatcctctccttgacaagcctactgcacagccgatcgtgcaggaccaccaggagcacccaggcttgggcagcaactgctgtgtgccattcttgtgctgggcttggctgccaagaagaaggagataaacatcaccatcctcaaagagctgctcaagaaatttttaaataagaaaccaagttatggggttaatctcctacacaattcatttacttcctttgaatgttagactcactcatgattatttgtgtttctaatttatagtttaagtttatttgtaaaaagttaaaagagagtgggtgtctgtggctctcactgatgttcactctggcatcctttagcatttttcttttttaatttcataattgtaggtcattagcgtgcatatcgagtttgcccttacgtggtgggagttcaaacacacaaagacccactctttgcccaaaactgttctctttggtttggaataggctgccatgcttttttaatgttattgcagcatgtatattcactacagcattcagacaaaatttgcctatgttctgctgttgtttgatctaatcttaatcacagtgagctcttccttagctcaatatgtagtttgcccccaagtgtgcactgtttattactttgtaatacgccactatgagtactgacatttagagttgtttaaaggccaagaactggaaacagcctttcctccattttctgtgtattggtgatgggagtgataaccttttgggggagctttttaaatctcacagaagaggaaagtggcctcctctggcaggtatgtgcaggatagagtgtgtttcatctgttccggtgccaggaattagcggtgtattatggtggttcccttaggatttgtatgtgctctgggctcatgaagatattgcatcatgagctgcagcagttgtactctttttcgatgacctaaaaagggcttatttctgaggaatgaaaggttcccatcgttgactgtggatgtggaaaacctttcctagcttagagcatttgtatctacaatacattttaaagtcagagttcatgttacctgttttaatcacatgactacatgtcccagtacacaaaagggcactggttggcattcttcttaatgtatttagtgaagatcataagaaatcctttatgagttcaaacgtccctggaacaggcatacaggctctagtcaagaatgaattagagtgaaggaaagctgtgtgacacctggcattcctctctgttcacggagattctttgaggcttgaagattgattttaccatctagacctctttggctaatacctattcttcaaccaccttggttactctgacataggaatttacttctttttccttgaatggaaaacactttaaaaaataatagaaacattattataaactaatatatgtgagatacttagttgaaacaaaaaggagttttagtagatggtattgtactctctttgaaaatcaaggagaagtttatgaaacttaaaatgtgtacaaactgcagtgcaatctactgttcgtgaatgtcaatgtattatcaggaaacgtgtctatacaatcacagagttatattttctcacagacttctttacaaagtgaaatatgtttttgtacctctgggtttctgttcgggacatattttgtgcgatatttatgtgattgtgcctatgcatgatgaatgaatacatttcagttatatattgcctaaatcgtaacttgatgatgcttgggaaagactcaacagttaaaacttcatgaagttctaatgtctgtgttccaaaacacatcacattgttaggatgcagggagataggtgtgtgtgctccctgcggtggggatttctagttactagatcatctccatttttagcatttggcatcctcatgatacttctataaatatgacattaacaggagagcaacaatacgattttaccgatggaataacagatttgctggcattcactgaaagagtgcaaatattcggtccttgtgacttccactgactcttccaaattttatgaatgtatcaatgtattagataaacccagtttcagaatgataaagaaaaaatcttagaccaaataatgcggctaattaacagtggtacgatttgtagcccgtgggtttaaaatgcacttaaagtcctgttctcgccttttattttctgaacttgccgcttttgcattctttgagttcagtttaaagacagttactttaagagcattttaaaccctcgggctagaaatcggaccactgttaatcagccacattatttggtctaacgttttttcttttatcattctgaaactgggtttatctaatacattgataaattattgcaaaggtacttttatcgttgaaatcacttcacttttaccctgataaatatcagtgactaggaatgaccttcggatagcgtttagcatctgtaaccaatctgacaataatgtgttcatgaggtgcctatggattaaatcacacactggcatatttaagctgaaggtcagtctggaaaataaatttactatattgactgaaataccactctttgtgtaggcatttgtcatatacttaagaaaacgctaaaaagaatggaaattgtatgacaataacttaagtctttctccaaagtgcatgcagtcttttgcgatacctcattcagccgagtatttgtgctcttcctcattcagtataaggcagctttcagtttgcttagaaggcaacattggaatgttagagttcatcagaaacatagaattttaaactgtgagttccactgaatacattttaatgtctgtaggaagaatcaaaacacctatttaaagatggcaatatataataatcattttaaaagtatttgattcaacctgataattttccagaaatgaaaaaaaaaatcagctctaaaaccaaagcgattttagaaaatttgaaaatgtaaatcagccctatccataatatagtttctctaaaactttatcttagtcattttaaaataatataactattaaaaaatgtaactgctatcttaatgttctgaaataatttaaaacattttaaaatatgaatactgtagtataaaagaaagaaatggtgggaacgaaaagcagagaaagaaatgccaattccagtccaaagttttatttgccaagttttcttagaatgaattttaccagtttatgaattattgtaaacagaatgtgtcatggaaatactgaaagatttttccctagagtggccttattgactgctggtgtgatgccactgtaatgtaataaattattaaattgtttcaatgtgttgtttttgccttaaaattttattttgtgtttcttgaaaactatagtattaaaggtattgatactgtgcaaatgctgggcatgcttggcacgagataatgtgtttcatttttacaaagttgtgatataactatgcaagtgtttcttaaaagaacacaagatttaaaaattatgggattaaaaaaagttatggggtgaaaaagttatgggataaaaaatgtaaaaacgttgtggcaaaaaaacttgtgggaacaaagtagaaaacagtattatgaaaagttaccaaaaaagttatgaaaaagaagttacgggattcttttttaaaaagtcatggaataaaaataaaaattaaaagcaggcccctgtcagcaaagcctggagaagtggggccggagtctccaccgccaccatgtccctaccaccccttcccaggcacccctttacaattagggtagcaggacaagacctctgtctaatggggaaagacaaacagaccctttgccaccttgaccagggctgagtccctaaatttctggatgatgatgattgttatttaagagccagaggctggtggagttggtttgtttggaggaggcctgatgtcccccttactctcaccatagcaacttttccctcaggggggctcccttcttattcagagaggtaggacagtggggctaactgtggaccaggcgagggcacgggctgctggggtggcccccgttccccggtgtacacattgtgtctgtgtaaggttttgtatattccagagggtagggccacccctgtgtcatacctagctgaggttggagccggcacatggggaggaggttgtaataattatttgtggctgggaaacttatttattgctagcataggacagaggaaggaggcggggatggggtcgtggctccctggtgatgcgactcctgtttattttgctttttattttggaataaatggatttagccatactgctcggcctggtgtgttcccgtttccctcactgggtcctggagtttgtgccaccaaacgaggagccccagagtgtcttgagtatgtccagctaggctgttagggaccttccaggcgtgttacctgtatgctgcctagtggcgcctgggggattccacggggactgccatggtgcctatggggcgcagtccagccctgacagccaacaggctcagaagcctgttgtagcggtggccaggaagacaggtaccagcacctaagggcactgacttccacccaccccaggcgtcttcccttccgtcaccttgcctccctcccctgtctgcacctggtggcctgttctctctgtccctccagagtgccggctgcccggcaggctcccttcaggctgagttcgtggccctgccccctggtggccagagccggcttcacaggacaagagccagctaagttccaggggctttccaggaaaagtgtcccttggaaagggtatggccttttcacccctccaaacagcaccctagaaatggcttggcctttcccctcccctgagctccacagagaacacagccagcagaggacacacttccccgtcatccagaaatgggtttgattctcagccaagggacagcaggactggtagagactgtcaggccacacagctgcctgcacagcactcccatgcttggtgggggggcgggagggatggcgggggctgactctccataggccaggcgtgacagggagactcaccggaggtcttgcactttggaggggcaatgtcgggacagctttctcttgttgggccacaagactccaagaggacagcacggtgactgattcccagcactagaggcgaggccgttggccacatgtaggtgtaggggtgtgtgtgtgtgtgtgtgtgtgtgtgtgtatgggtatttatagatatttatagaacaatgcgagggcataccacagaggggggcacaagtttcacaacagtcacacctggacgtgtcagctcaccactacaacagactaagtcacagatgaagggggctggctttggggctgggggagccactgccaagtcacagaacagccgcccaggcaggcttggaaagggaggcctccgagaagagaagggatctgtttagaggtcgaaggggggcgtggggctctcaggatgggatggacttgcgtgacctgatcggctggcagttggagagaaagcagagagaaaagaggagagagaaaagggaggagagagctggtgaggccagtgcagagcacaggtgtgccacagcagctgtgggagggccagggaggggagggcgcaggtgcggctgtggcaaggttcctggaaaagaggggctggaagggaaaggggaggaagatggagggaggagccggagcttcacaggtagtgcctggggactgtggcggccctccccaccccacacatgctggcctcttccattgcacccaggcagtgtacccacaggtcagaccaacgctcggcccctttgggcttccctcttctctggtcaccaaccaacttgtcttccaagtcgtcttccaacctgtcttccaaccaactggtctagggccacctctcaccttggggaacccaacataacagccaccaggcctgacagaaggaaaattgctcgaacaaggatgatgaagctaaatgggatggatggttggagtgatcgccggagccccctctgggtggtcaggaagctcaggaccctctgaagggaccctgggggaggcagggtgggcaggcagccagatgccactggctataaacttataagtctaagaggggagcctcagcttgttggagattgcaggtcccataggtgaggctgggtccttcctcccagggaaaggagacggagaccatggcaagggaggtgggtgggcttgctgggcagagctcagctgggccagcaggcactgggctcccctcggctgaataggagggccaatctctaggagcaacaagccaaggtgcgtgagcccgctggctggtggtagtgcttcagcggggcccagggaccctgccttcagtcacatgctagcagctgtgatggtacctgggagggagggaagggggctgtgtgcccctacctgacctgtgaggtgtgttttgggttgaccatgtgtatgggactctcgaggttttatcctagatcaccactgttttgccaacagatagaggaggtgggaccctatcacccctgctctgcagtggatttggccctcagcactccaaggcatccaggctgggagctggatgccccaccctggcagcatggctcagacagcacaaaaggcatggtgtgcccaggatgacattcctgggcctctggccacctcagagtacagccccacacacaaccccctccaagctctcagcccttacaccataaaccacgagctccctgatggctccagagaccacccacatctgccagcttgggcacggagcctgttccaagagcccccaggctcagccatgggggctggggagacttggggccataggggccagccctggtacctgcgtctggcaaggacgctctgcacctgcagccaggagctgtccacgggcccccatgtgcgtgctgatggtggttgtgttgatgtcaccgatgatgctgagcacctccttcagcacgtggtacatgcgcagcatctcatctcgccactgtgcctgctctgccaactcctccatcagcgtgttctggttcccatgcaagtacaggttggacagcaactctgataatatgagctccttggtctgagagggggcaaagagggaaggaggttgggacctgatgcatgtgctggcctgatgcctgtgctgggacagtgtgctggacttggagccctgagtatggctttgcacacgcggcttctacaccgcttagactcaaagatctgccaccccaccgcccttttctcactcagatagggacactgaggtccagaggaaaagtcacctgtccaaggtcacacatctgggaggggacccaggacctatcatgccaccaggacacctgtctactcagtttcttaaaaatgttttttggagataggatctcgctctgttgctgggctggagtacagtgagcaagatcaccactcactgtagcctgaacctcttgggctcaaagtgatcctccaatgtcagcctgtcgaatagctaagactataggcatgtgccatcactaagcctagctatttttaaaatttttgtgtagagaccaggtctcactatgttgcccaagctggtctcgaactcctgggctcaagctatcctcctaccttggcctcccaaagtgctgggattacaggcatggaccactgtccctagtcccacattatagttctatgagacagctctggtctggactgtgcctccctccctgaacctggtcccatagggctggtcggcatctcccccaggccaacatggccacctgcatccccagtgccacaggagccccctgcccctatgaggtggtgcatgcacgttgttgatcatgacgtgcatgacggtcttgggcatgaaaccaactatgaggtcccacacagtcttgttgacaatggccttgtaggagtccacaaggttctgggtggtttccatttgccgcttcagctgtgggtccatggagtggacttaagattgagtctagacctagactgctgccgggctttgcaaaacccaactggagttgggtcctgggctgctctctgtggttctgaagcaccatctcccaccagtgtggctggttccccttaatctgcatctctggtgtctcctatacagcctctgccagaaattcaaaagcagagagggcttttattttctatcttccaaaataaatttcaaagtattattggcaaacttgaatagtgacttctgtttcataatttttcatcgccttttggtttcatctttagaaagttttttaagttatgagaatttttctttcccttagaagttgatgcacataaatccccttgtttgccacattaatggcagaccttactttcccctccccgattcctgcaggggatctccaaaaatctaagcgttaggaaagagcccagccaatcgcatcccagtggtatccccacccttcttcacctctcccagactgtagccttgccccaccctctcagccaccagggacactcacagggaatcttgttaatctcattgaagaacttctccttcagtttggcaaacatgtcctcctggctctccccagcactcccactctcggtggagttgtccacgggtccaatgggcatcgtgacggtggtggtggcaggagccacaataggctcttggttcctcttgaaaatgttcctcatggtggcagaggggacagatggggatgagaggggaagagggcagggtgagcatcccagaggttgtcttcccctcagaaagccatgcccaaaggaccaggagaagctctttatcgatcaaagatattttgcataatattaacaactgtagtaaaccaataataatagacatcatccaattagtacacagtcagcctgggtagcatagcaagaccctatctttagaaattttttttttttttaattaggcatggtggaggctgaagtgacagaggatcacttgagtccaggagtttgaggttacatgaactatgggtgactaagtaaggttctatctcttaaaaaaaatagtagtacatatatgtgccaagcactatgcaaagcactttccatgcattattcatctaatccaaaaaataacctaatggtttttattgtttccatttaacagatggggaaacaggttcagagaggttagaaagtttttccaaggtcacttagctgtaagttctgaaactgaggtttgaactggtctacccaactccagagcttgtatagctaatcactctcctatatctcatttaaatctaacctcaccactctaggaaggagacaaggttttacactgagggctcctctttcaacctctctccttgacttccaaggatttctagatattactctgcctagaatctctgcccagctccatgacacttgaactctccacatccctgactccaattcctcctcctgccctccaagactcctcagccctctgtagtttcttcatgggctccctcagtgcccactcagggtttgttttgacctctcctgtaggaagacggcacccacatctccatctctagcccttcctcccgggtccactctgtagcccctactccaagttcatctctagccctgcccccacatgcagctgcacattagccttcctgcatcaaagatgtgatgtttattaataacataacccagacttactgtagaaaatttggggagagagagaaatccccccataattctaccctccaaagtcaactagcatttggggcattctatgctggtattttttctgagtatgttttacatgttgaggccatgctatgcatagtttttttgaagattttttacataaaatttcatcataagccttttcctttattgttttgtattattaaatagctacagaatatcgtactacatggtaacaccataatttgtttagccattccactattagacatttaggcagttttcaactttttgctagtaaaacactgagcatatatgttggtcttcatttaaggcaatgttcttacgagcttccaaactctgcccccccataattctgtcctctccaccgagctctttttgctcctcggggctatgcactcatttctcaactgaaagtcctatgagggaagatcctgtgttggcaacagcacccctcctgccaagcacacagtgggcactcagggtatttgttgattgaggtcctctgaggcaacatagcagcatacacccacaggtattccaggatgcaggaataaacagcacaactccctgaagcatccgttttactgaatggcaatttacagtatttttaaattaaaacaagctggaaatatagagtaggatgcatacagcacaagaatttaaagaaaaaatgtgagacttttcttactgcatgttagggatgtgttaactctcctctggactcagggttcttctgaaggaacattttagaagctcttaggttctgtcccttcctttcaaaacctgctgagatcccctccccagccctggagactgctccagccttaagtacttttggtgacctgcacattgatgcaatgtaggttcattcaccaagcatttattaaactcttactacctgccatgttgaaatagccttgaccccaaaactggtcttgaagtgaaaaaccaaggtccactggacttcacctctggggacaaagagatgggtgcagtttggcgggaactgcaagtagccacacaaggggataaatatgtgtccagggccttccgccatgtccatctcccctcacttctacaaaactgttaagggctctgtgacctttttttcaaaaaacagctttattgagatgtaattcatatataagtcacccattaaagtatacagttcagtgcattttattgtattcacagaattgtggaacaatttgcataacctaagtagaacatttttgcgacctcaaaaagaaacccagtcccattagcagtcacttttcgttcccatcctcttcccagctccagcaaccactaatctactttctgactctatagatttgtctatcctaaacatttcctatcaatggaattataaaatatgtggtctttgtgactggcttctttcatttagtatgatgttttcaaggttcatccatgttgtagcatgtatcagtatctcattccctttttattgccacataatattccatggtgtaggtagaacacttttttttttttttgagacagggtctcactctgtcgcacagctggagtgcagtggtgcaaccatggcttactacagcctccacctccagggctcaagtgatcatcccaccgcagcttcctgagtagctgggactacaggtgcatgccatcacaccaggctaattttttaattttttgtagatatggggtctccctatattgcccaggctggtctcaagctcctggcctcaagcaatcctcccacttcagcctccgaaattttggcattacaggcatgagccaccgcaccttgcctagaacacattttatatttatccgttcatcaatttataaacatttgggttatttccactttgggctattttataactaaatatggctaataatatcccacttgtggggtattatgaataatgctgctgtgaacatccatgtatgtttttgcatggacatacgttttcatttctcttgggtatatacgtaggtatggaattgctgggtcataactatgtttgacattttaaggtgccagcaccaatttatgttcccaccagccatgtatgagggttccaagttttccacatcccagacaacacttctttttttttttaattatactttaagttttagggtacatgtgcacaacgtgcaggttagttacatatgtatacatgtgccatgttggtgtgctgcacccattaactcatcatttaacagtaagtatatctcctaatgctatccttcccccctccccccaccccacaacaggccccagtgtgtgatgttccccttcctgtgtccatgtgttctcattgttcaattcccacctatgagtgagaacatgtggtgcttggttttttgtccttgcaatagtttgctgagaatgatggtttccagcttcatccatgtccctacaaagaatatgaactcatcattttttatggctgcatagtattccatggtgtatatgtgccacattttcttaatccagtcttatcattgctggacatttggcttggttccaagtctttgctattgtgaatagtgctgcaataaatatacgtgtgcatgtgtctttatagcagcatgacttataatcctttgggtatatacccagtaatgggatggctgggtcaaatggtatttctagttctagatccctgaggaatcgccacactgacttccacaatggttgaactagtttacagtcccatcaacagtacaaaagtgttcctatttctccacatcctctccagcacctgttgtttcctgactttttaatgattgccattctaactggtgtgagatggtatctcattgtggttttgatttgcatttctctgatggccagtgatgatggcattttttcatgtgtcttttggctgcataaatgttttcttttgagaagtgtctgttcatatcctttgcccactttttgatggggttgtttgtttttctcttgtaaatttgtttgagttcattgtagattctgtatatgagccctttgtcagatgagtaggttgcaaaaattttctcccatcctgtagtttgttttgctgtgcagaagctctttagtttaattagatcccatttgtcaattttggcttttgttgccattgcttttggtgttttagatatgaagcccttgtccatgcctatgtcccgaatggtattgcctaggctttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcgtttccccatttcttgtttttgtcaggtttgtcaaagatcagatggttgtagacatgtggcattatttctgagggctctgttctgttccagtggtctatatgtctgttttggtaccagtaccatgctgttttggttactgtagccttgtagtattgtttgaagtcaggtagcatgatgcctccagctttgctatctatgacaaacccacagccaatatcatactgaatgggcaaaaactggaagcattccctttgaaaactggcacaagacagggatgccctctctcaccactcctattcaacatagggttggaagttctggccagggcaatcaggcaggagaaggaaataaagggtattcaattcagaaaagaggaagtcaaattgtccctgtttgcagatgacatgattgtatatccagaaaaccccattgtcttagcccaaaatctccttaagctgataggcaacttcagcaaagtctcagtatacaaaatcaatgtgcaaaaatcacaagcattcttatacgctaataacagacagacagagaaccaaatcatgagtgaactcccattcacaattgcttcaaagagaataaaatacctaggaatccaacttacatgggacatgaaggacctcttcaaggagaactgcaaaccactgctcaatgaaataaaagaggatacaaacaaatggaagaacattccacgctcatgggtaggaaaaatcaatatcatgaaaatggccacactgcccaaggtaatttatagattcaatgccatccccatcaagctaccaatgactttcttcacagaattggaaaaaactactttaaagttcatatggaaccaaaaaagagcccacattgccaagtcaatcctaagccaaaaggacatttgctattatgtctttttgtttaccgtgatcctggtggaggtgaagtggcatttcattgtagttttgatttgcatttccctgatgtctaatgatgttgcatatcttttcatgtgcttaagggccatttgtgtgtcttccatagagaaatacctattcaaatcctttggtcatcttaaaatattttgtctttttattattgagttgtaagaatttgtatatattctgcataccagttccttgttgaacatataatttgcaaatattttctcccattctagggttatattttcattttgtgtgtgtggtgtttttttgttatttgtttttgagatggagtttcactcttgttgcccaggctggagtgcaatggcacaatctcagttcactgcaacctctgcttcccaggttcaagtgattctcctgcctcagcctcccaagtagctgggattattataggcgctcaccaacatgcctggctaatttttgtatttttagtagagacggggtttcaccatgttggccagcctggtcccaaactcctgacctcagttgatctggcctccttggcctcccagagtgctgggattacaggcatgagccactgtgcccggtcatattttcagcttttaatggtgtcctttgaagcaaaaaagttttcaattttgatgatgtccaatttagctatttcttttgttgccatatttttggtgctatatccaagaaaccatcactaaacctaagggcactaagatttactcctttgttttcttatgggagttgtatagttttcagtctcacattcaagtctacaatccacttattttttaagacacggtctcactctgtcacccaggctgaagtgcggtggcacaatcatggctcactgcagccatggcctcctgagctcaagtgatcctccagcctcagcctcccgagtagctagactacagctatgtgccattacacctggctaatttttaattttcttctagaaattaggtttcactatgtttctacaatccactttgagtatggcataaggaaggcgttcacattcattcgtttgtatgtggatatccatttggtgtataacatttgttgaaaagactattctgtcctccatccaattgtcttattcccttgtaaaatagcaactgaccacaaatatgagggtttatttctggactctcaattctatctgtatgtctaacctcatggcaataccacactggttttattttttattatttttttaatagcacctgcctactattgaccatactgtcttgattactgtagctttgtagtaagttttgaaatcaggcagaatgggtcttccaactttgttttttgtttgtctgtttttgagccaaggtctcactctgtcacccaggctggagtacatggcgtgaacatggctcactgcagccttgacctcccgggctcaattgatcctccaacctcagccttctgagtagctaggactacagccccatgccaccacaactggctaatttttgtatttttgtagagaaggggtttcaccatgctgcccaggctggacttgaactcctgggctcatgcaatccacccgccttggcctcccaaaatgctggtactacaggcatgaaccactgcaccaggcctgttcttctttaatcaggatgttttggctattctgggttccttgcatttccatatgaattttaggaccagcttgttaatttctacaaaatagctggaattttgataggcattgtgttgaatctgtagatcagctcagggatcatatcaacaatgttgagttttccactattttcccacttatttagacctttaatttccttcaagattgttttgtagttttcaactacaaatcttgcacttcttttgttcctaggtatcttactctttttgatgtcattataagtggaactgttttcttaatttcactttcagattgttcattgctagtgtatagaaatataatagatttttgtatctcagtcttgtaccctgccatattgctgaactcattggttcttttttttttttttttttttttttttcagacagagtctcactctatcgcccaggctggagaacagtggtgcaatctcagctcactgcaacctctgcctcctgggctctagcaattctcatgcctcagcctctctagtagctgggattataggcatgtgccaccatgcagggctaatttttgtatttttagtagagatggggttccaccatattggccaggctggtcttgaactcctgacctcaggtgatccgcctgcctccacctcccgaagtgctgggattataggtatgagccactgcgttcagcctgaaatcatttgttctaataatttgtgtgtgtgtgcgtgtgcgtgtgttggtggattccttaggattttctagatatagaatcatgcaaatgaagacagttttccattttctttttcttccctaattgccgtgactagaacttccagtccactgttgaacagaagtggtgacattgggaattcttgtctttttcctgatctttgggggaaaatctttcaatctttcttcacttaacataatgttagctgttagctgtgggctttttgtagatgccatttatcaggttgagcctagctcctccattctacccttgcccctggattggcagtcctcctcccctttctgcagacagctgcccacagccggtccacggtccctacagcaccccaccctctcactctccactgcagggtgggcaggaggcagcacgggctgcgggaagaggctgaatgtagtcccaagaatgccaaccacttgtcatttgactccaaacaaatccctttgtgaaacttgatttcttcaatatacaattgtggaaaataatacctaattttcagaactgctgtgaaaaatttaaaaataaatttggttgtgtctggcacatagagggcattcaataaatgtgggttggatgtgaatctgagaagtgttcattgaaccttatctgaggcacctggaagtggccctggcactgtagagggacccaaggttcatggtggatgcgggctttctctccaagactgaccatccagaaatggtcctgtagcaaagtaaagctgcttggagtgaaatgaaccagccaggaatgaagatgtttaatgctccagaggttcagggaacctgcaggccaggaatgaagggggagaactgcatttcaggagtgttggagtccaagaaaaggagattagacttccctctatacccagcaggaaccactgaagggtgctgagcagttataagtggggtttgtgaagttagctccatggggagtggagcagggaggctggttccacagaccagaaatggtaaagacctgcactaggatgggaaggtaaggaatggagtagagagaacagatgtgagagacacattcattcattcattcattcattcattcattcactcactcaagtatttactgagctcatatcctgcttccctcatggaatttaccatgcacttcacataagtgcatatgaaattgtaattatgagaagtgcaagaaaggagagccatctggtggtggtgagcatttataaaggggcatacctgaactaatctgggaaagcaaaagtgctttcttgaaaaattgatgattgaactgagacccgaagggtgggtatttatccaggtaaagaggagatgaaagggcagcctaggcagagagcacagcctatgcaaaggcccagaggtgggatgcagtgtggtgagtccaaagcctgagggaaggccagggcagctggagtggatggagcatggttcagggtgaggctggcaggccgggcagggcagaatcaggggcaccataggctgcgtcaaggagttttgtccttcgcaaagaggaatgagaagctgtgggaggccttttagggtgggggcaggggtaacatgtacaaatgcatattttgaaagtttcactttggctgtcataagtaaaaagactaggatggagcataactccagaggaaaggggggaaagagttgaaaacagccaataacaaatgtcatccccgagctcttatgaaagacagacagtgttcccggggaacctgccagaggaagatgacttagagctgcagagagggaatgtggggagtccatgaagcagcagcagcagattcgaggcttttccagactccaaaaaaaccaggaggctatagctgcccagacagcaagggaataaaagatgcctgagaaggaggctctcggtcaaaggcaggcatgggcagtgggcccagagagtggatggggtggattcagggcccacctctcagttatgcacccagtacatggcaccaggtgctgagaccagaagccttggggtcatccttcccatccatgtggggtcaccccccacatcccaggtgtctgcaaactcatcaacaacccacagtgccttccaaatctggccgctttccaccctccacctggagtaccacagtagcctccaatctggaagcttccactcccctccactcagcctgatctccacactgcagccagactgatctatttaaaaccctcctgtggcatcttgtcacatttagaataagatccctgcctggcctggcccctggctggctcccacaggcatctcctgtccctgctctcagtcactcagttcctgccatgctggcctcttgctaccagccacaaacccaccaaacagacccccagcccacagcctcggcacttactctccctcagcctagaatgctgttcctggagaaatctccctgaccttcccgggccaccatcagcccctctagtcttcttttcccaccatggtctgtggtgcctacaacttgttcacaattccctgcactcccttggcatttttgtggtattcacctggcaaagcgccagccctggagaaatcccactgacagctttctccttctccatggctacccctgactgctgagccccctggtgagagtctccccacagtacgagggcagcccgtgccccatcagtccccaggatcatccaggccctctgcactgcacagaaactgcaggaaacgcctccccaccagctttgcctcctcctccagtctccgcaggcctgtggctccctcacacccctcctgtctctttcctgttgttttaaagaaaaataaaagtgagaaatctctcaaaatgtcccagcctcgggtcaaaccacagacctttcctcctgaccccttctcagttgagggcttttcctctggttaagccagttcccgctcctgcacaggatccctcctgacttctcaggaagtctttgccatccctgccctttcttgtgcctaacatttcccccttccctcggctgaggctggaccagtccagtttatcacatcacccaccaaaaatgagctccacctgctgccttgttctccctttccctttgtgaccacacacacacacacacacttgcgcacacacatacacacatgcacacacatacacacacgtgcacacacacacacatacacgcaacacatggtccccatttcatcacgtccgcctcactcatcagcccctccgttgtggcttctgccccatccctctgctgaagtagttctttgtaaagtcatggatgatgaacacaaggtcactaaacccaggccacattttcattttccttgagctggacccctgagctgtggtcaccagctggccgctgcctgctttcatcataactgtgactactcctccttcggttgcctcaggcttgcccttggggtccttcccttctcagccatggtgtctccctgagtggttccttccacaccctggcatcagtgccatcctcttcggtcagattcaagccacttctgagctccaggcccacaggtcaactggcccccgacatagccgcctgatctgggtctcctcttgctcacctccagtcagttccgtatttgccaccaaggcaatcttcataaaatgcaaagccggtcatgtcgccgtaatgaaaagccatcccagggagacaggccaaaagccctagcgtcgcctacagcccctcatgctctccatccagcagcacctcggctttccctccctgggttgctaacaccagcccatactccttcttttgtttcccctaatacactgtattaccctcctcggggcctttgcacatgctgtgcccccttcatggagctaaatcctatgatacagtttggatctgtgtccctgcccaaatctcgtgtcaaatggtaatccctgatgttggaggtgaggcctcgtgggaggtgattggatcacagggtcagatctagtgatagtgagttctcatgagactggtcatttaaaagtgtgtagcaccctccaacccccactcccctgcctcttcctcctgctctggccatgtgaagtgctggctccctcttcaccttccgccatgattgtaagtttcctgaggcctctccagaagccgagcagatgccagcatcatgcttcctgtacagcctgtggaacttcgaaccaaccaaacctcctttcttcataaattacccagtcttaggtgtttctttatagcagtgcaagatcagactaatacagtctacacatctttctcagctcaaacagcacttccaagtgcaccttcctccacacacccatggctccctcctcccctacccagcatcaaggccccaaccacctactttcccggctctccattctcatccccatggtactcatgcagcttgtgactgtataagcagccacctcatttgtcttgctcactgctgctgctctagtgcaggtgttggccaacagcagtccaggggctaaatccagtcccccacctaatttttgtaagtaaaattttgttgggacgctcacttgtttacacatttgttgttgttgttgttgagacggagtctcgctgtctgccaggctggagtacagtggcatgatcttggctcactgcaacctctgtctcccgggttcaagcgattctcctgcctcggtctcccaagtagctgggattacagttgcccaccaccacgcccagctaatttgctgtagttttgtacagaaggggtttcaccatgttggccaggctggtctcgaactcctgacctcaggtaatctgcccacattcaataaatatgtgggtctgtaaatgatcaagcaggaaagacttgagattgggtcacattatgtcatttcacagaagacactgaattctgtggggaagtggccttcctagggttcccccgtgcagtacaggctggctctgggcccggggctctttccacaaaccatgttaagactcagtcgtcatcaggctgtatccaggggcacccactcaagcatagattgggaaggaaccaaggcctggtgtgagagtgtgtgtgtgtgtgtgtgtgtgtgtgtgtgtgtgtgtgtacagtgagaccccaaagctggcatgggaggtaggggcattgcgcacagctttgggaactgcccacccttcctctcctcttgcagcaggcctaggactatagagagtcagacataccccgttatgaaccatttcacctcatgtggtttctttcacctctctgagtgtcagacttctaaactattggaatgcagcttttattcctaaaccctcgagttgaggctgggattaaatgagacgttgcatgggtggagaccacatgtccttcccacagcccacgtctacccagcatgtagagaaccactgcttatttttcccaggctgcccttgggttgcatttccattttccctgggagacatgccagtagctgagagaccaagattccctcggctgtctctccttctgatgtgaccccctatcacctggctctgctgtcccttgtagagtcagagaaaaaaaaatgtagaaagaaggaaaacagcaggagccctttcataccccacatgccacccccaagactcctggaggcccggagaagtgaagccagttgtccagggtcgcacaggcatttggtggaggaagaatctaaatccctggacccccagtccagtgcttccttccacagcccagcagcctcctccgcctccaggactatttcccccactctaggaggcagggctcccatggctgtggaggaatggcggtgagaacggtgtgagggagagccaaattatcgggaactcacagctgcctcgcctcccgcatggctgggagctgcagtccctgggagagcagccagctggaagactcaaggacgataaatggatctgggtgccagggctcccaggacagagtgaactcctctgtctggtcagaatcacccgagcaggaaagcatgaaatggcaccattaggtgaaggctgcagctgtccggggagggaggctgggggtgtggagagatgcctgctcccagcctgctgggccacaggtcaaggtctgaagaggaaggggcctgggaggccccaacaagggagaagacacacaagggaagggactgaggaagggtctctcaggcttggcctgcatcaagcccccctggggagtttgttaaaatgtagaccctctgccatcgcacctgtctcccagagcctaactcagaaaactcagtggactggaatgtgcccagggatctgcatggtaacaagcacccccatttcctctcatgcaggtgatctgggcaccacactttgaaaaaatgaggttctaagtaattcagaaattcttgccagagaggtcaaagtccaagcccagttgctggaagtaaaataagcctcagaggcactgcggacctggagggcatcaaggcagggcaggcaggaggacattggtggcaacaacaggttcaatcaccataactctgtttggtgagcacacagatgttctcatctaacccacctgggaggagggcacaattaccagcatcatttcaaagacaaggcaaattctgctcagacaggtcgtaagtgacctgcccaaggtcacacagttgatcagaataaagaaccgggtctaaatttgactgaggccaggtctcctgctcaggagcaaggtagggggcccagtcctcagggaaagctcaggaagggggagtctccaatagtgggaaatgatgctggagaagcaggggtggaccagaagcaaggtcactaaacagaatccacgcaggaattcccttctctccctggtccactggccactgtccttctgtctgcccaggatggccacttggcccctgtgacagtgtcagtcccaagcactcaggcctctgcaagtggccccaaggctgggagcaatgggtccaggaggaaccatgcttggcatgcatatcccagcacagaccctagaacatgcctgggtctcggagtgctagttaactgcctctggccccctttgctggggagaacagccacatttggcctgggttgggtgaggagttggggagcaggtgacaacctggttggcttatcctttatcttatccttttctttctatcatgtagagagctgtcagggcagaaagcaggacttcaggtgagtatcaaaaagaatgctctcaacagagagcctagggatacaccaggatggggagtgcagggggaaggggccaccatctctccccctattatgagccctcttataacaagcagaaacagcatgtctagaggctctctctttccttaactccaaatgcccagatgtgctcagagctcagccacagttcttgtacctaaactaaagagagacttgattgacaatcaagttgagtaggagggaaggggagctaggctggaggaggaaggtggggtgagacgacctcacacactcaccctcacactctcagtagttctgggatgttctgctttgagggtctttactctgcccatggtcagcccacgtgggagaatcacagaagacccagatgccctggagctttgctctgtgtgggtgaacagggaatgatctccaagggagatagtggaagaatcagtgtgcaggggagtgagcaagatacctgtgtaaaagggtgggggagaagcatatgtatgcttgtatgcttctatattcacagcacggctctggaaaagtgcataaggaatcgatgacattagctgtagttgcttttggggagcagagttgggaaagcaggagctggaaaatatttcactgggtatctttctgtatctttaaaattttgaagcccatgaaaatctgcctgtctcttccaccctctggtacttcagaaccctggagctggatcctcagccttgagaaggagaaaacaaacgaggggggtttgtgtgtttttaaatttatttaattttattttattttttacagacagcgtctcactcccttgctcaggctggaatacagaggcgtgatcatagctcactgcagccttcaaactcctgggcccaagcaatcctcccacctcagcctcccaaggagctaggaccacacacatgcatcaccatgcctggctagttttaaaattttttgtagagacagggtaccactatgttgctcaggctggtcttgaactcctggcctcatgcgatcttgccgccttgacctcccaaagtgctgggattataggcatgagccactgcgcccggccaaaagagagaacaaatgagtgggtttgtgtagctcacccggaaatcgcctgacctgctccaggtgggaggcatgctgcagggagaatgccaccaggacctgcccccctcaccctcagaggacacctggactctcactttgcctcttcttccctacaaaaagtcgggagactagaagccctgttgtctcctctagcaggcttctgggattcccttggtgtgcccccaaatgagactgcctccaaaatgggatcctgatgccacatcaaagatgagtaagttcgatcctcaccctcaccaaaagcatatgtgtgtgtgtgtgcacacatgtacacacactcaccatcaactgccaccccaaatcaattaaatatgatctggggactaggcacttctgtggattatcccactcagtactggcctcgattaatgcagataatggagagctgactggatacagcttacagtatttaatctttcccggcattgtatttgcagaagccaaagtaatgagatggaaataggttaaccagcaagacacctgtcgccgaagctcgtaggctaaaaagatcaatacttaaggagaaatgtttgtctttatgttttgcaccagtgcttcagtccaacatttggtcctgggaggctgaggataaagtgttaatgaattaattttctagctcattctgaaaataaattacccatttctttgagttccttgtgtaccgaggtctgatgagccttcttggtcagtccacgcacacctccactttggagcaaggttgtcattctgcacacatagaagcagagtctgttcttgactggccctggggaagctaacaactcccaggttcctgagagttggaacgtccttctagtgtctaacttcaatctctcctgctgcggcaacactcattttccttctcttgcatctatgctgagatcagcaatcccaggccacctgatgggcacctcagaatccaatggctgaggattgagcccttcctgcatcaatcttgggctggcctgttagcctccctgcgcttgtgcagctgtgtgtgagggttaagcatccctgccctccctgccttaaggactgcttccatgatcaaaggtgaagtttcctgagtaaggctctgcaaatctgcagcacctcacgcctgcctcggattatttctctctgaacctagaccccaggcatggatacccttaaatcacagacaaatattaataaaacccagcctgtgagggctgaaggactcttacagacaatgcagtccacagcctcttttcgaaaacaaagaaatcgaggccccaaagggaggtggcttacctccatcacacaaacaacaccactaaatggtggcagaactgcctgagttgtcaattcctggattccaggcctttgtagctcctcaggccaccccaccaagccctggctccatttgatccttggctaactcttgtagggtgtaggggtagcggtggtgagggggcagagggatgccctggccaggcaggcccctcagcacaccctccgctctgccaccccagccaggatcaacttgaaacagcacagaggagcccgccatccccgtgggagagaagctggagtccaggctccctggagagggagttaatactgcagcacggcgcactctagccaaggcggagaagctgctgagtcacagtccagctgcctggccagccctgagctgcctgctggggcccccagctgctctcagcccagggggctgcctctggcccccagacaggctgccttcccacctccttctccagagactcagcatcttgggcctccagggttccccactccccagcaccccacaacatctcccaaacccacaggcagctgtcctggggcggaggagagggtcttccattggttgagtgtcaagatgcttgggagcacgccaggaagggtgggggaccccgaatgagtgattgagtggggacagatggaggcttggggaccagtgggccctgggctgcctggtgtaggatacggaaagtgtgtgtgtgtgggggtgcacccgtgggccccaggaggtctgttgtgcgcatgctctgagtgtgagggaggacgggtaggaccgtgggggtctgccctggtcgtgctcccaagagaggcactgctttctgcagagcgcgtgggcaactgtcagctggggaagcgctcaccaggggaaaggggagctctctgtggcttagcagtgattaacccacacaatcaatggatcctccagccacagtgtgagcagctctgcctcatgtgaggcacacagcaccttccagcacagtcccgatatctttcatgccagatgcacatcttcaatttcagctacaaaccattacaaattgatgcattttctttctgactaaatgttacaaggtttgaacatactatctctgccgatcaccgcccctctaagggatgggtttagaggtttggcacgaaagcaaaagccttttaataggagtgcgtgagtgtggtggtgtgtgtgtgatgtgagtgtgcatatgtggtgtgtgtacgtgtgtggtgggtaggggtatacgtggtggtgtgtgtgtgtaggatgtgtgtgctgtatgtgtagtgtgtaatgtgggctctagggtgtgggggacagtggggtgtgtgtatatggtgtgtgtgtgtgatgtagggggtggtgtgggttaggggtggaggctctagtggggtgtcagggggtatgtgggtagtggtgggtagtggcatatgtgtggtgtgtacatatgtgtggtatgggggtatagtgagtttgtgtgggatgtgtgtgtcagtgcatctgtggtgtgtgtaatatgtgtatgtgttgtgtgttgtgtgtagtgaggtatgtgtgcagtgtgtagtagggtgtgtgtggtgtgtgtgtggtgtgtgttgtgtggtgcatgtagtgtgtagtagggtgtgtatgtgtggtgtgtgcatgtggtgtgtgtggtgtgtagtaaggtgtgtacggtgtgtctgtgtggtgtgtagtagagtgtggatgtgtgtgtggtgtgtgtggtgtttagtagtatgtggggtgtgtagtggggtgtgtgtgatgtgtgtggtgtgtgtgtggcatgtagtagggtgtgtgtgtggtgtgtgtctgtgtggtgtgtgtggcatgtagtagggtgtgtgtgtgatgtgtgtggtgtgtgtgtggcatgtagtagggtgtgtgtgtggtgtgtgtctgtgtggtgtgtgtggcatgtagtagggtgtgtgatgtttgtggtgtgtggtatgtgtgtggtgtgtgtctgtgtggtgtgtgtggtgtgtagtagggtgtgtgtgtggcgtggactgggggtgtaaggggagggggtgttgccagtgtgcggggagggggaagggagcaggggcaggagcccgggctgggtggcaggtgcccccgctcaagctgcgggagagtagctggagagaccgcagcctcctccccagcctggaggcccggctcctcccttcctgtggcccggcgaggagacctagtggtgccccctgctgtccgtccaggagcctgccgcctgcctccagccccatctccacccaagccaggcccatgccctccgcacacagccgcacccccgccaggctcactgcctcccaggcccccagtcaacgctcacaccctggaaaggaggaggtgggcaaccggtgggaggccggaggcagaaggaggctccatcaacccagtaatggagcagaacatcagcactgtggcatctgctagccggcagcaccggggtgggggtcctgtctccatctctcaggcccagctgaaatgggtgacagcagccagtgcagggacgtggcagagaatgccagaaaggctgtgtatgtgtatgtgggtgcacgtgagcgccatgtgtatgaacaccatgtatgaatgtataaacatgcatgaaccggcactgtgaacatgcatacaaacattgcgtgcaggtgcattacactgccacatgtagaaatgtgagaagccccagggaagggagggctgggggtctggggccacaggacttgtcccggaagctggggtgatagctacaggccccgtacttgggtaatgggagggggtggactacggtgcaggtcaccttacagcctcggggttggaagagaccacagggtcaccagcccccaccctccctctgcagcggcaactcttgccagaccctctgtctccaaaggtggcaagaggtctgggacctgaaagaggcatcaggagacctggtttctctccacttctttccatcctttggaaagtggctttgcatctcccaagatagcctctcagctttcattttttttttttttttgagacagggtctcactctgtcacccaggctggagagcagtggcgcaatcacagctcactgcagcctcgacccccacgagtagctgggactacaggcgcaccaccatgcccggctcttttttgtagagaaggtgtctcgctatgttgcccaggatggtctcaaactcctgggctcaagcaattcacctgcctcagcctcccaaagggctgagattacaggcctgagccaccgcatgcggcctagatagcctctcagcttttagaaccgagccttccgagatgcttggagagttctacctctgaaggcgagcgggcacaaagagtagtggggtcatgagagaacttgggctttagaacagccagggctgctttccaacctgacacttagcagctctgcagccctgggagatgagttcatttccctgggatcatttcttagctacaaaccgaggatcaggtgcctgtctcacagggatgttatgaggattgaagaggccacatgtgctggcacaaagtggtccctaaataaatactcatttcctttcctcagttctcctctcagcggggctaggccgagtccatgctgaccatggactcaaggacggaccttgtgttacccacaacgaggggtgcagtgctcgccaagtcagggactctgagccagccccggctctgtccaggagggcaagggttgctgcagaggttgtgcggctggggagcctgaggcccagaattctcttccctggctctgtgtgttcctcttgcagagactgcgtcacttcttcctggtgtcaaaggtacttgtataagcagctcagctcctggaggatcactaaggctgtgaggtgggaacgtgtcttgttcacgactgcatttcctgccagctcccagaggagcagcctgattgctgagcctggtagcaggcaatggaggaggtgggggatctcagcaggcactgcccccccaactctggcaacctctgtcccatcaagctccctgctaaaggagagaagagaaaccccaaagccgaaagaggcaccctgtctagttcagaccctgacacccagggcctgagtggtcatgggtggggtgtggatgggcaggcgcactgccttgcggtgctccactataggtaggcaggcccgtggctccccatggggaaagaaggtccagtgcagctcaggttctctggagagtcatgcgcgaaggaagggcatgaagaccacttccccagttaatgagggtttggccaggagttgtctgccttacccaaccttgaaaataacccctagcatgtttaattgcttaaaaatccactctttcctctgatcttcactttcgttttctccaaatcctatgtcaggctccgtgctaagtgctgggaatacaagaagaataaaacccaaccccatcctgaagcagctcacggggagacaacagagctcaggcctttgggaggtgcagcagatgtggttctgccccttgacagaggagacagctaaggctcagagatcagcttgcccaaggcctcccggtgcacttgaaccctgacttcctagcactcagcccagggctctttccttcccaacaaacagccccagggagctcctgaagcacactgggaaggtgggtctaacgggaagaccacaaaggcaccgggctcagaggtgggtgccgggggcagggagggagacctccactgtgcccactccgttccagcggtgtatttcatttcatccgggccctgtgaggtggggactgtgattcccattttgtaattgaggaaactgggcctcaggcggagcgaaacaggtcgctcgctcacagcaccctttcccagaggacggaaacagctgtactcccaggcagcagagtagctcgctttgggccacaccgggacctgggagaggtcatgagacgtctggagagcccagcctgctctcagtgggagctgggagccagccaaggaaggtgcagtctggtcctcccgtttccaagagcgcctccgtccttccagatgctggccaggcgccagggacagagatgtacccatcactcttcagacagagatgcccattatcaccaacacctatgacagctcgtggtctccagaaactaaagtggagcatgcaagtcccgggggcacaattaggtgctccaaagaagccagctctctcctgcctgaccgggagccgggacagacatgggaggtaggggccaggagggatgaaccatggcctcaaaacacccatgggctggaggaggggagcaatgagggggagaattccaaattggaaagcctcaacttggaattctatgtggatccaaacctagaagacagctctgctgaggaagaggagccaagtgaaacaccaggtgcagccaagtggggtgaattagcacctgggctctggacagactgacctggactggagtctcagctctgtcacttttagccatgggaacttgagcaggttgcttaacctctcttggcctcagcactccatctgcataacgggaatgataatggaagctgctgtgcagtgctgcgaggcttaggagcactgtatgtaaagcatggcattatgtccatggctggttcctgagccaggctgggcacaggcctgtcagaagcacacggggatggctccagtggagaggtggggcagcctctctgctaaccccctattaagggccagattaagccacccctttttaaaatttcctgggataattcaggcctctcttaatcaatggtcctccttctacccatgcctttagctccagcccagacggccttcttgatgcccacctctgggccaagtcctctcttctgagccactgcactatccctggcttctttcctgcccctgtgtccagatcctgccaagcctttccccgtcctccagcccaccttccccaatactcaggcctctcagcagccatggcttctccaaccgtggctgctgagtctctattttggttgctctaattttcaagttctcatttgtgggtatctgaccacatcctcctctcagaagtcagcagagtctagctgttcttcctctagctgccactcccatcctatagatgacaacactgggatgtgaagaggtgaggttgcccagactccccaaggatgtcccaggcaaaacctatccctagtgtggtggctcatgcctgtaatcccagcactttgggaggttgaggccagcctggacagcacagtgaaaccccatctctacaaaaaattttaaaattagccaggcatggtagtgcatgcctgtcgtcccagctactcaggaggctaaggtgggagaatcactggagcccaggagtttgacattaggtgagacctagccatgccagcagaccagccaagcggccatacccagcaggcagcttggaggggaggggcaggtgtgttgctcagaagtgactctggaagtcactagcacaaaagaataatccgctggggagagtgtgggcataagaagaaatccagagatgggcttctagaaatatcagcatttggaggatttgtagagaaagaggaaagccagggagattgaggaatgaccaggaatcggaggaaagctctgaagaacagaaaatgactccatggcaatagagcggttacaccggaggggcaggcaggggctgggaggggacagggatccttctggggaatttctttggtgattatactggtgcatatatccataagttgtgcactttgctgaatctaagttataacttcatcaaaaagaaaaacgaatgtgcagagcagaaagagctaggggtggacccctggctcccacacactctggcttgaccaggtgctggaggacaccatgggtagagagagcatagaccctaatagagcgccgtgcatcccatcgccaaccggctttcccatgatgcacaggcgcttctgctgagaaccacagggcaaaggcacctagaaccagggagccactgaggaaaggcttcctggaaaagcagcagggagccaaggtttaggaggagatggggtgggcttggaagaggctggccagtttccaggcaagagacgtccacctgggtgggtgtctggcaaccacagaccatgatgggacccctcacagccaccaccctggaaagcgcagcgatgacagctgacttgggaaggtgatgacacggcagaacacaccccggctccagagacgccatcatctgggaccctctccacagagcctgacttagggcaggagagcctccctggtccaggacaccagaggcctcaaggttttccctcacaggagcctctttccacacccccggccccagcaaacatttgagaatgggccgttgccctgcctagcagtacacagggctctggcctccctgctctgggccagaggagaggggaaatggaattgggcagaggactgtcccttcatatgaccactggtgacaaacactgtgtcctgcagagcacggcccaggatgaagcacctccacccacacacatggcattcggcagctgcagggcccagccctgcaccatttctgaaggtccacacatagcacatatcacagctgaggaaactgacagccagagagaggaagggacttgtccgaagtgacagagtaagaagcctgccttactgtgctcttccaagctggcttggaatccagtgctcttccaagtgctcttccaagcttggaatccagtgctcttccaaatcatccagtgctcttccaaactggcaaaatcctgagcctcggagaggcttactgagctccctgcctaccaaagccagcatgggtgagcatctgtggctctctggaaccgcagggagttccagtcaccctgctgatgacccctgcttggagctataactataagtggaatacctggggtggctcctattagaccctgactccctggagctggcaacagagaaccagcatgtaacagtccccacagacggagctagcctgcatcagggtttctaatgttctgctgcaggttcacttcgcacttgagaaggaggaacgacttcagtttttttctagcagcttcttggctcttcccagtggcccctcccccaagcaaagtcccctgagaggaaaaaatcacaccacatctttgtggatcagtggtgcctctgcccccacccaagacaccgggcatgtttcctcatgaagagtgacttgcggctccttcgcagcactgagggctggagccagaagaaggatgaacccactgcgggggtcttctctcttcatgttggaaaacagatttaggctcaaaatgaaggagggtttttgcacagtcagcaccacccattgatgagttcgtggtcccaggaggtaatgagtgctccatcatcgggagcattcaagctgaggttagcccactattgggagggatattatagacaggactcaggtaaggggacacagcattgacctagatgaaatttgaggtcccccttccaaccctgagagcctctaaatctctgacatctccatcccagcccttgctgccaattggcctcatttgcctggccctgctggtttgccaggcagtttgtcctcagagagaagtagctgccaattatgtggggaccacaagagtttcctttatgacatcaccactctgcaggaaggggctgaggtggggtaagagaggagaaacaagacagaaggtggtaccagagaaggagtcagctccccagggcctggaatctgcagtgttgccaccactaggtaatttgtggggcacactgctgttggggtctcaggaagccaagtctgggcccagaagggaaatagcccagttctggcctcctgactggggtgggggactgtcaagggaaaaataagcccaggctagctctctgaggctcattagagaaaaaggtaaatgtcgaagacgtgtcatggcaggcagctcattaagcccacggagcttaaaaatagtgagacacacagatattgggggatggggagctggggatgagacgccggctcatcacactgcagggaagaacagcaaacctgggagaaagtgactctataaccagtggaagaaaggctgtgtagccatcaccggatctctgggtaagcttggcgcacagggctgctggaaatgtcagaccctgttctgtcgatgagaagactaagcccagaggagggtgttcccaggcattacccaacaggctcgactgttctccatgcaggggaagagagaagacacagagacacagacctgccccggaggaatccagagcccacctgcccagagaggctccacctgatttccctggctctgggcacccccttaaaagccctttatgccatctttcctttcagtcgagtgatgcaggatttgggaccagacagcctttgctcaaatccttccacagttatctaccagcttggtggccttggagaagttatttccctgttctggatgtgcttcctcttctataaactagagacactacaaattcccaccacagaggggtaaatgcagcatcctgtacgttatgtgtttggcacaggacctgggatgcaggaggcactctgaccggtggcatccaggaagtaaggaatatggactaaagggagggccaaggaaaagtttacaggctgtggctgtgcagttggaagatgcagaagcgcctcgctgggtgctgccaggttaggtttgcagaatgcagtgaatgctcttgctgacaaaggatggggataagtgaactgggtaatcatgacctaggggaagccactagctcaaatactgatccctatttaagtcaccaaaatatgctgggcacccagtgggtgcccagcgctttcccataagtgatcccaaaccaggagctagtccaagcctccaaaggtggctgggtagttcattggaatgagggctgcagtgactccagagggagcaggactccagaggagcaggactcaagagaaggggagccagggaagactgaggggatgtgtaggtgaggtggctcttttctggctgagagaagagaaggtccccagcccacaccaagggctccataatggaagggaggcctagggtgggtcctccccctccccatcttcatcccactcagcccctacctggcctttaacacactgggtgggagaagtgttgctgagcacagcagtgacctgaggccctgggcactcatcccagtttagctccacaggggactccagttgctgaggaagaatatagaacttatataggatgggggagctggaaggaaacttaggatcaattgttccagcctctaattgaatggtggggaaacccagagacagagaaaggaaattactaccccttccaagccagtgagagagccagatctagaatccagggctctttccatgatattgcacctcccatctcagtcctgtctttatgaaatgccatattgaagctttatgtattggggaaatttaactgaggctcaaacggacacaaattccctaaagccacatggtgagtcagacagcgaaatgcaaggtgtctggtcctttcccagcatccaacgaacgtttcttgggcacctactacagtcaggctgggagcactttcagacgttctctcacttaaatctcacatgtgggagcaagttggtggaagagcgaagggccagaggccagggtccaaatcctggctctcttagctgagtctccttggacaaatcccttgatgtccctcaaatgatgcctccatttcttcactttataagaaggggattcataatagtacctaccttgtagagtattatgataattaaaggagactatccatatgaaatacttagaacagagcctagtaatataaatataccatttaaaaataagtatactggctgagtgtggtgggtcacacctgtaattccagcactttgggaggcccaggcgggtggatcacctgatgtcaggagttcgagaccagactgaccaacacggagaaaccccgtctctactaaaaatacaaaattagctgggtgtggtggtgcatgcctgtaaccccagctacttgggaggctgaggcaggagaatcacttgaacccaggaggcggaggttgcagtgagccgagattgtgccattgcactccagcctgggcaacaagagtgaaactccatctcaaaaaaaaaaaaaaaaaaaagtataccatttgacaatcctaggcatatacccaagagaaatgaaaacacgtatccttacgaaaacccttccacaaatgttgatagcggcattattcagagtagctgaaaagtggaatcaaccaaatgtccatcaactgatgaatggagaaataaaatgcagtatatccacacaatggaatgttatttggcaataaaaagaaataaagtaccgatacatgcttcaatgtggctaaaccttgaaagcattatgtgagtgaaggaagccaggcaccaaagaccatgtgttatataattccatctaaataaaatatccagaaggtgcaatttcatagagacagaaagtagatgattagttggctaaggctgggaggaatggaagaatcgagggtgactgttaatatgtatggagttcctttttaggggtgaaaaaatgttctgaaattagatcgtggtgatggttgtgcaattctgtgaatatattaaaagctattgaatcgtgcccttaaatgggtgaattgtatagtatgtgaattatagctcaataaagctgttttcaaaaagtaaatatatatttataaacttctataagatagtaaatcatatccattccaatttaatgataaggctcagagccagtcagcaacttgcccaaagtcccatgcctaggaggccgcaggacctgattttggactttgtgttgtcgaactcctgaagctcctaagacctgatccagttcagactcatggagagcaggcctgcccttatgtatcttggggaaagcctccattccctgtcccaatgaggccactcaggaagttctccccgctctctaatccaaacccatacaacttacaagggatgatattcagggggatatgaggtcaggagcagggtcacaggagacaggcaccagaagggaaagctacatttctaggcaatgctggatatcttctttagggaagcctggggaatggggcagatgaaatatagtggacttcaagacatgagctcacggttgattttgggggtgaccttggccaagaaacctcatctctggggctcttggtaaaatgatattcaggaagaagctctgaggacagctccagaagcagacatttctaaggctatttataaagtggccttccctctccttacacacaactcaccccagatgatcaggtgggaagtctgtagggcagtgggcatcacttggttgcttgcttgggtatatacaacctggtcacccccatggttcttggcagaagatattggggccaaaccaagaggccctaacctaaccatcactccaatactgtgagcaggtcaggttggctctccctcccagccaggaaggaggaaagagaaggaagcgacaagggcactaacaaccagggtccttgtcttacctggcaggaaagatgctgaatgtgatattgactcaatgtgctgcttctgatcagccccctgcctgcctccctgcacagtggatagtctggctgcaagtggtagggggaaggagctcccacttttgacaacccaggaaaggcatcacctcagtttgtctggagctcatggccagggtgtcccagcttgaaggagaggttctcctgcccccttctctgcttgtacaactatacactgcattcagaaacactccttctcccttgctaaggagcattaggagatacaaaaccaccatcctttttccaggtgaaataaggaagaacagaaaatgaggagggccagattcagcccagagccacccagagtccaagtggcctcactgggagagcagtacactgggtttggtgcccttggtagaaagcccaacatgccaggacctcagccagcaagccagcatgtgctccagagcagggacagggagaggccaacctgtgcatccgctaggctcactggctatttcagaccatcatctgcctcattcgatcccaggacatcttgggagaagtgaggaaggcaggcatccctctccacattttttaatggggaccactgaggtccaagagatagggaaaaaccgcttgcctggggccatgtgcagtaacttaatagtgggttcactggattctagattcttctcatcaaagccaatcatacccctgcctcgccccactcccagctctgctgctatgtttctttacctacaaaacgtcagtcagttttcagaaacaccataataacactctttatagcactttatggcaaaatctttatagcaccgtgtgtcaggcactgcctattcttagagctatatgtaaatagtcatacatcaaatcctcatgccaacctgatggcaagctatttcatttccattttacagatgaggaaactgaggtaacaagtgtttaagtaacttagccaaagtcccacagataaaaaactggaggagctggcatttgaatacaggcaacctagccctagcatctgaggtttaaccactgcaccacagtgccaagcacatacaagtacaaggcttcgcatattccaagtctcactaaaacatggactaggggctgggcatggtggttcacgcctgtaatcccagcactttttgaaggctgaggtaggaggattgcttgagcccaggagttcgagcccagcctgggcaacatggtgaaaccctgtctctaccaaaacaacaacaacaacaaaacaaaaacaaaaacaaagaaaaaccttgcaaaacaaaaattatccaggcacggtggtgcatacctgtagtccccgctatgtgggatgctgaggtgggaggatcacctgagcctcgggaggttgaggctgcagtgagccgtgatcacaccactgcacttcagcctgggtgacagagtgagaccctgtcttaaaaaacctgaaaaccaaaaccaaaaccatggactaggggcacacgactaggctcaggacgaagtgtgtgtgcaggaagtccacataagtccagaagctgggctgtgctctcacccaggtgccatgtgctgggggcggggatgggggacaggctgcaatttgtctctgagcagccagctgccctcaagtcccagcccagccgagcagtggggagcaggttgaaggcaggcttggagctggcaggctccgtctgccccactgtgagcagcagctttgagacactctcctgccggctgctggtaggtgctgcagtatctctcctggctgcagggctggctgggctgaggccaggccaagggccttccttccccctttcaccctctgcccctccctcagtgcccggggccaaacgaagggcttaggaagctactctggctttctggtctccaaggactgccggccctgatgattaatttggtggctgtgggactaggtttagtcttgggtggcagcactgacctccaggaatgtcactgtggccccttcaggggcaggtaacaaacctggctcattcccaagagagtaagtgagtccggtggatcaactcccacggttttccacctagcatatttgccaacagcgggcaattcccaggtaggaagtccttccttgtacctcacatgagcccttcctgctgcagtatagccacattaccttctactagaaacccttctgcttccaaatgcaccctttgttaaattgctaagatgtgattccatgagcaacacagcaatcacaaaagccattgaagcagacggcagctgctacagggttcaagcattccattccagctggggaaaggctgtgggctttgcccctccttccccccccagcccctccccaatctcaggacacagagaaaagaggagcaacatgcggagaagaaaaatggaaaggtaacaaagcaaaggcagaaaaaaaattcacagcctcccttgacctgccaaggacttcttccacatctttccctaggcttgggggcccagataaggaactgagactttcttttttttttttttaattttattattatactttaagttttagggtacatgtgcacaatgtgcaggtttgttacatatgtatacatgtgccatgttggtgtgctgcacccattaactcatcatttagcattaggtatatctcctaatgctatccctccccctccccccaccccacaacagtccccggtgtgtgatgttccccttcctgtgtccatgtgttctcattgttcaattcccacctatgagtgagaacatgcagtgtttgtttttttgtccttgagatagtttgctgagaatgatggtttccaatttcatccatgtccctacaaaggacatgaactaatcactttttatggctgcatagtattccatggtgtatatgtgccacattttcttcatccagtctatcgttgttggacatttgggttggttccaagtctttgctattgtgaatattgccgctataaacatacgtgtgcatgtgtctttatagcagcatgatttataatcctttgggtatatacacagcctttcttgcagcttctgcagcctctgcctgagagatccgctcaatgggccatctgctcggaggcctttctgcaaaagctttaagagttccatttctccagggagctggaagctggggaggtgtcagctccaaacaataagggaagtttattagggatcagggtttccaggaggatggtgcctgctaatggggctggatgcactctgaggtacaaagggttatttaatgcggaaaatccaaaagctcctttagaagtcaagtgctcacacccgaggccctacacactgcagccttccttttcactcaaaaaacctgaaaaccaaaaccaaaaaccatggactaggggcacacgagtcagctcaggactgccaacagcgggcaattccctggtaggaagtccttccttgcacctcacatgagcccttcctgctgcagtatagccacattaccatctactagaaacccttctgcttccaaatgcaccctttgttaaattgctaagttgtgattccatgagcaacacggcaatcacaaaagccccatcaccctaccctgtttgcccctaccccgccccatcccaagtcacacttattccctgtcctttgctactgggcaaatattgactttctttcactcagccttgtcaatggaagtgagaccaatggggctggctattgtctccctcctctctcctgtcagagggcaaagcaagctgtcagcctcaacagcgggagcagggccaactgagacaagctgagaaagaaaagtgtggtcttggaagtaatatttctgtcttttggtcttttgtctttctgtcctccctcccttccccaagcccatctgggtttatttttttcacatttggctatcctgctgccctgtctggctcaagagcagcagcgtggcatagctggcataactgagagagctcaggcctgggaattcaagtgtctgatactgggtcaccttatgctagttctttaattttcttgggcttccatgttctagtctgcaaaatgggaaggttggaccccatgatctcagtatctagatcaggaagttccttcctatcaggacccatgtcctttctgctgcagtcaaggcattttaccttgtgctctgatttcagaaaaaatggaaaataactgcttggtgcttaacagggaggaaggaaagagcgttgcattgaggttctacaagggctggcaagctccatcgctggtactaacatgctgtgtgatcctgggcaaggagctccccctctctaagcctcagtttccccataatcaaaacagagggctggatgagatgatcccacagcccctttcagtgcctcgtcctgccgtggcactcatctaacacatccctgcggaaggcgatgtcccccgctccttcagcttttctccaaggcagcatctcacagcctttcctcatgactaaccttgaatggagggatgccatgccgctggctcgtgttccttcatcatcaggagccttttgtcagccacactcctctcagactcatgcttgcttggcctttggcctttgtggctgagctcttcctttctccaggtcccatgatgaagaccagagcatgcaaactcctggagcctgcggccagtgcacagcaggaggacgacacaggacattggggcattttgggggattgtgtgcatggtgacaactgcaggactgtgaactgtatccctgctcttcctctaacttgagccctctctgtgataacacagaacctcaaaaacccattccttgtgcattagtcagtatcacactatggacttcctattccaggttggcaatattcccttttcacagatgagacaattgaggctcagagaggttggtaatttgcctgaattcacacagatattaaggagcgagccaagatgggaacctagatgtatctatctgcaaagactttgctcttaaccgtcagcgctcttactgagaaggggaggtcatcgcctctccccaagctgacttacaggactggaatcacagggcagtgaacacccaaagcctgaatgactccaacaaacctcccaccccctccacccccacccagcctcggcaaaagcagagccagcagggtcgtggatcaacaaagccagaaggactttgggtcatctaaaccaagctttcacttcacatacaagaaaactgaggtccacagtggcgtgcgacttgcctaaggtcacacagcaagtctagggtaaacctcggtcccggccatggggtcctgggagtccccctccaggttgagccagtccctttgccactccttccacctgggtgtagacatgccttcagccactcactccagggacatctggccttacccctctctgcttctcagttggtcccttcctagaaggttcggggaatggagtaaaaggcccattttatcataaccagaggtgtggcagagagtggggaagggagaaccaaaggaaaacaggtgtgagattattggaaagtcaagcagtctctctgtttcccatgaagtttctaatgcagaatggtcctaatgatcagagagagagagagagagacagagagatagtgctgatgttcccattttgtagggaagctttgaagatggtaggggaagatcacactgcaaatctacaatctttccctgctccccatggccactgctcacagctgccctgccacctgcttgctacacagcttgtattattattattaacaatagctaccactcactaaggacttagctcagtactggaccaagtatttacatatgcttcttgtttaatcctcataaaaaccctaaaataccaccactattctcattttgttttgactacttagtaactgaagctctaagatataaagtaatttgctcaaggtcacacagctaataaccagtagagccaaggtctcctggggactccctccaggggtgtgccgggctttgaaattcatatactgtatttgtctcaagttgtcttgactctggtgacagaagtgggagggcaatgcattgggaattcctggagaccacctgctcccatcacccagccaagcccacttcctgctactcagacaccagcccagaactgcagccacagaattgtggggttgcaagggcctgagaagttaactagttctaccttctcaatgtacaggggaggaaagcaagaaagggccttgcccaaggtcacacaaggtcacaaaattggaggcagagcctgtaaattaaactcagctctcttgtctcaaactcggactcgtccgcaacaccctaatgcccagtatgaagttattgtctcatctcaactgaagacagaaccagagttcatcccaaaaaggagttagattagactttcctatggcaaggactgtcacattgcacagtggggtgctctaggctattgtagtggagatctttctaaaacgagacaattccttcagatcttccttatctgagatgaatgcagccctgtctggaggtagagagcagacagcatgaccttgtgaggtccttgacatcaccctttaacctatggtcatctgtctgtcacagcgaacctttccctaggaaagaatctgccctctgcaaagaggatgtgtaatgctggaaagcccgcctttctccccatcagctggattctgagagttgggagagatgaccaatgaacaggctgagggtgtcacagccctgctactttgggatggggggtgcagtaggggagctacagtcttcccagaggccaggtcattctacccagctgcaccccatccccaacctttcagtgggcgacacctgcagggtgttgggactgggagaaacctcagataccttaaattccaaaccccattttccagatgaagatactgaggcccagagtgggtcagtgagttgcccaaggtcataggacaggtcagaatggaagctttccgactctccccggggcgctgggttcacagctccaccttgccaccccctgccccggaagtgagcactgaagtcacttaagagaggccagtgaccaaaggcagcgattcccaggtgcagaggctggggcagacgtgcccatgagcttgttcccccgcgcaccctcccccacctcgtccccattcctgtcttggttaccatgtgcctccatcatcctgagattcagagaggtgcagcggcttgtcgaaggtcacacagcacactgagtagggccctcgtttccactgcccagctgccccctcccattgcccacccgggcctctgcaagcttgccaggatccccgggagcctgcttcctccaatgcacagagccgtggcgcgtgtcaaagtgtgggaaagttcctgggagagggaaggggtagaaaatacagccgctcatctcaaccttggacggctgcggcaaggcaggggcgctcagaaaggcagccagtcctgcgcaccgccagtgcctccggcacaccccactctgcgccaggggctccccagggtcgcgcgagcatgttcttccagctcctcctcagcgaagcaggcgcggcggggtcccacgcgcccagcacccacttctctccgcacgcccacttcatgcacctccccgcgcccttcccacggcttctctgcggcgagtcgcctttgcttccccgcaggtccccggtcccagcgctaaggcaccgcggcttctctcgccttctctccgcgttgaacccgggctctccgcggggagaaataggttgggggcgaggggttcccgagataattcaggacacctccccggggtctagccaggtaattccgacgcccatggatttccggattacagttcccaccgcgggctcagtcctactcttagtttatcccgcggtgagcgccaagccccaaaagtcggagtgtcaccgtttggtgaccccgcgtccgcccgcgcctcaggccctggaggtggccactgtcggtccaggcacggcttcgctcgggactactggctgccctcgtggggtgccccgcctggggttccctcttaccctgggacgttccaggcgcgttcagcctgagctggtggagagggcgggggcgggggcggctggggtcccgaagtccaggtccctcttcccacttccccgccggccctgccgctgcggccctcgctcccgcgctcgctcgctctcgagtctctccctctctctcttctcttcctctctctctctctgcagtagtaacaacctgatcccgcttcccccacccgcctcttgagatgctcctcacatccgcctgcacacagcgcgtgcggcccctccgaaggcgatccccgcaaaccgcgacgcaggtcctccgccccaggcaatccccgctgcgggagaggccgcctcctggcgcccacgccccccttctgcagtccgtactgccggccgagggggaaatgggcgacaggggaaggggaggtgtgtgcgggacggactaggctggggcagaggggtttaaactggcgcggtcctacagaagtttgaggagggcggggccggctccgagcccccggagccctacgggactcccccgattctactgaggagtccccgccagctccgtgcactcctgcaacactccccaccccacccgccagctccgagtttacagcctctcgggtccggggattggctgggggaggggacgggggggaggggaccccctggctgtagggaacggcgtgcgggcgggggtgggagggaaacgatttgcttcaggagatagggatgaaggttttcctgagtcaagggagggagaagagaggtggaacaaaaggcagatgctggaggggaaggggagctggggagctcgccccgagggctccggcagcccgcggtcccctgcctcagtctgtcccagagggtgaggtcaaggctggtgccagggctcttcaccggccacctggagaggggagaaagagggatgcaggggtacggggttggggcagaggaggaagagcgtctgctggcacaggaccctctgcctgctctcagataggaacccagcagaagggctctgccatggacccaacacctcccacctccgcagatctgctttctcccacttgggaaaagcgaggctgacacccactgtgagcaccaggaggggcaggaagaaccgagagcctgggcagcactcctgtgcctcagtctcatccttgggcctcaccctcaacccccaacctcacccgataagacctcggggccccagctcgccaggtggaatttctgctgctgtctggccattaactgcccctgaccttcccagctccacctcaccctcgccctctcccctcagcctctccttcaccctccatgcagctgctttctgtttgccttctgctctgcacactcaggaccaggactcgagtttggtgtttgacccaggaagtgacattcctcacccaccaacccacacacacaaaaatcctgtgtgcatgtgtgttgggggggaggggcagtcattcagggctttccagggcttctcatccccacagagtctggggaactgggaaattcccaatacccgcagtgaatcccccttcctcccctcctccaggcatcccccgccccaagacagagaccttactccagaagccggggactgcagtgctgcagcagccgcggctcctggccggcatggagcctctcttcagaagggcagcagctcgcttgtcacagaccctggacggcagaaaagctgattcagggatttccgggcggctcctcctgtgggggagtgtgcatctgcatacctgggtgttgggaagggtgtgtgcgtgtgttcatgtgtgggctgggggagaggacccatgcctgagaccctctagtcaggtctgctgatccctcactgttcttcagatggaaagggggagctggggtaaagggctcaaggtcagatgctcagcaggagggcaccaggggtttccccccactctgctacactccggtaacctacccccaccacgtcgccccacactgaggaggggacctgtcacctgagatgggtgtgtgggctgaagagcagtacctgctgctcctcttcggtttctccctggggagagaagtgcttctgttttgaaatctcccccaaaccttcttttgctagaaggagggaggatgggactgaaatttcattcagcaggctggattcaggtttgactttggggtttcctgatgctaagggtctggggcagcatcctgcttgacagggaaagcttatgccttcacgattggaatgtagtgctgcttagatgaaaagggatggatgaaatgacccccatggttccttctgataaaatggaccaagagacgcctgaaccttatacaaagctgcctccagtaaaacaaaatctagttacagaaaataaagcacttctgtaaggttatgtctgctccttctgaaaataccgtgtttaatgtctgtgctgcctccaatgtgtcctttcccctcttgggtggaagtggaattctgatggcctgtggaaggattgggtgacacttgcacaggcagtggctgggccacaatggcggaggatgggaacacggtgggtccctggagaaaacacagctgtgcttcacccaaagccccttcaggccccagaggacccttcccctgatagggatgacaatgacagcctgacagtcttaatttcacttgattcttatcaactttcccaggaggcagcaaggcgaggaagggataattcttcactccactgaggcacagggagcccccaaagggtggatgactcacccaaggttctcaggtaggttcctaccttaccctggggttttatgtttctattctcaacactaacgtttctcattcctccacaagttaaattgctcactccagccaactgaagcatgcttttcttgacacagttagctcgaggcacacggttggtgttaaaaaaaaaaaaaaaaaaaaaaaaaaaaaaaaaaagagcgttatgtcaatttcattgatcaacaaaagtgatggctccactgcaaattcaagttgatagtgcctgggcctcttgagttcaagagccttctagacaaagggctctgagctgaaacatgagcatgcacacatatgcctgtcgctgggtctgatgagataatttgcatacttggttgttatccctgagcattttcctgcctcaatgcacgtgtagccaacacaataataatcatagctgataaaggctaaagctgaggactttcctgagccaggcagtggctttaaaacctttaaagtggcttttaaaactttaacagctaaagctgaggactttcctgagccaggcagtggctttaaaaactttaaagttttcacatagactctcactaaataatttctgtttttcagatcaacaaactgagactatcacatttgggattaagttaaaaaaagaaagaaagaaagaaactgaggcttaaatacttgcttaaagcaagtatttcacagccagcaagtggctaagttggaacttgagcccaggcagtctagccccgggatcctgtgcccggcagaaaggtgctgggtcaagggaggagggggcagtcgggagcgcgcgcacgctctggacttgtgcacccgcggaaaagggtgcgccgagggggtaggggcgacggggatgggggcggggtaggggcgacggggacgggggcggggtaggggcagccctttcccaggcggtagcgggggcggtggttctgttgtcctgttgcccttttaagctgcggcttgacaggggccgcgcctcctgtcggtggagtcggttacaaagggagcagccccccaggccgccacacagctcccgccaagacctggtgccccttgccattttccagccgcgctcccaggagagtggaggctgcaggaagaggcgggtctttaggctcacaagagctcggccaggcggccccgcggggtggtcgtggccatgacagcggctccagacggctccccttccacgcccttcccgccggagatgaggggaagatgtctgtgtcaagattcaaggccaaactgaagttgctggcgtctatcttccacgagaaccaggaggctcagctgcggctcacgctccactgcaacatgaggtgaggcgcccggcggcggcctcgcggggcaggaagagggcggagagggggtgcccggagtcccgggacaaaggggaacctgccccggcgaggctccccgcccctttctcccgcaactggcccggcccgccccgggactgcgcgaggcttgggtgggaggaggcggcgggcgcgtctgtctctccggctcctcgcatggggctgtcttgggggccactggcccctctcagcccccgtcgccgccccccgaggtgggagcccgcggtggcgggagccctctcgggacccatggtcgccctcagtcagccggcctgctccggggaccgcgacagggcggggaatggcggcttttgagcccaggcggggaaaggcaaaggcctttaagattttcggtgttcgaaaccagcctggctaacatggtgaaaccctatctctactaaaaaatacaaaaattagcccggcgtggtggcaggctacttaatcccagctacttgggaggcagaggcaggagaatcgtttgaacccgggaggcggaggttgcagtgagccgagatcgagccattgcactcaaacctgggggataagagcgagacttctctcaaaaaacaaaaacaaaacaaaacaaaaaaaaacaactttttttttttttttttttagacaaagcctcactctgtcgcccaggctggaatgcagtggcgcaatctcggctcactgcagcctacgtctcttgacagtccacggattaaagctattctcctgcctcagcctccggagtagctgggattacaggcgcccgccaccacgcctggctaacttctgtgtctttagtaaagacggggtttcaccatgttggccaggctggtctcaaactcctgacctcaaatgacccacctctgcctcccgaagtgctgggattccttcaatccaatcaagttgactctgagtattaaccatcacaagtgtcttcagaattgtcattcttttctgctgtggcctccctctcctggtttgcagacccatgctccgcctgtgacactaggatggggaggtgctggcaggagagctttctagctcctgagttaaaaggcagagatggagtctgttttaagattttgctgctgtgttgagttatattaaaaaacattttgtcttttccctctggttttcacactcatagtaagaggccatcaagataggcttcttatatgggagggtgattcttaccaactgtagttgggacaagaacggtaaagaatgttagattcttctggaaaaaagtggtccctccattatttggattgggtttgtggccttctcaagcccagcagtctaattccatctgctttgtgtcttccggcatgtccctgtagttttggttcactaagggtattctccttgtatctgttatttttctgctgctgtgtcagacttattctgtttagtaaaatactgtcattttggtgggattttggaaagaggaccaggccacatcttgaaattcatcttaggattttacaaccctaactcactttttgttttgattaaattaccctttttgaggggtgggggctcagctttatcatttgcaaaatgaaggatagtaactgggctgatggttacagatgtggatgcgtgtcagaatcacctcagagagctttttaaaaacacattctccccagcactttgggaggccgaggtgggcggatcatgaggtcaagagatcgagaccatcctggtcaacatggtgaaaccccgtctctactaaaactacaaaaattagctgggcatcgtggcacgcgcctgtagtcccagctacttgggaggctgaggcaggagaatcgcttgcacccaggaggcggaggtggcagtgagccgagatggtgccactgcactccagcctggcaacagagcaagactccgtctcaaaaaaaaacaaaaccaaaaacagattctctgggtatgctttgaaatgagcatttcaaaaatgctctttcaatcactgatgcaaccaaagtctttgggacttttaggctaagaatatattctttagatacccagaatagtttaatgtggagtataacaatttagggaaatgaagaagggttgaattacattttggaagctgctgcttgcttcctttttccatttagtttttagaagacaaagaatgtctaaagagatacagatttaaagcaaatataagttaattcttcatgggtatgtttatctacatggctttctccagctgactgatccagaagagttctaataccctctgtgatcatgggtttgtttttcttaagaattactccatcagagtatctaagaacagatgcttagatactgctgagacctttgttggtcttacttgatctctgaatcctagttttttgatcttctacatattctgggttttaacctgtactggccttcatggttaaagaagcatttatatactgtgcccaggccaggaagcttatcttttgaactttgcccaaactgtgtatgaaggcccttcttaaaaccccattaaattcatttctaaacttgatcattgtaaattgtgtcagttggtaaattctgtcttgtagggaggtattttgtagtaaataacatgtttttaaaactaaaatttgccttttagtaaggtggtaatcatttcataattcttagttttgtcaagtgtctataaataacacatctgatcttttaaaatgtaaggcaattgaatttatgtaatgattcaggcttttcaaagttaaaaaggtagttattttaaggaatggatagtttgtgatatttattttaaacaaaataagccattgatcttatacacatagccatgtaagtaaaatgttttcttattttaaattagattacattttaacatttttttcggttttgctttgtatttgactgattgcttttctttattcctaattcttttattctttgttccgtttttaaaagctgataactgttgtttgtcaaatcaaagttggatttaaaaataaacatttaattttaataagctctctgctagtggcactgcagtgacagatggttgagagtttgtccctaaagctatggcaccggtcttctaattgactcaccctgtattcagcctgtgtagccctggcagattctttctctgtttcagaatgggacaacagaagaagtgacttcagaggaagaggaagaagaggagatggctgaagtaggtattttatataagaatgacatttcataaatgtcgtcatttttgatttgaggaattctctaaatctcctttgtaaactactattaatgtggaataattgaaagcacattgtatttggaatggaatataatttctcacctctggctttacctctaactgatgatacatctttgagaaaattgctttatctgaattctttggatttgattttctggaaaacaaaagctcttaacttttagcaccaaagttgtacttatatttaatactaatcagtccttaacctgtatttggttatttttaggaaaaggaactactaagtttaaaaaatgttatgtttgcataaaaggagaatttgagaacatgttagggactactcaccagaagtagtgacactgtctcttgttgaaaaatcatcaaggaattttctcttagtctgttttatgctgctataacagaataccagagactgggtaatttataaagaacagacatttattttctgacagttctggagactgggaagtccaagatgaaaataccaacatttggtgtctgagggccttcttgttgccacctcacatggtagaaggcagaaggcagaagggcaggagagcaagctagtccaatgtgtgaagcctcattcatcagggccttaatcccattaaggaggaaggagccctcttggcctaatcacctcctaaaggtcctacctcttaatatcatcacattggcaacacctgaattttggagggaacacattcaaatggtagcaaatttagtagagcacattccaaagacattgagcctaggccagttgtcagtcatgggtctaattttagacattttcaggctctgaagctttgcatttaaattcaaactccggaacaaagatctgtgtctctgcattgaccaaatagaaggtatgtgaattttatggtcttgatcgttttacaagattttttctgtttggggtcttataattaatataggctttcattttcttggtttggaaattattaatctaaaatatactttacagtgcttcagaactaaagaagtagtgttgtgggcttgtttttgtttgttttttttaagatagggtctcctgtcacccaggctggagtggagtagcatggtcacggctcactgcaaccttgaactcccaggttcaagcaatcctcctgagtagctggaactacaggcgggtgccccacgtccagctaattttttaaattttctgtagagtttgagtctcgctctgttgcccaggctggtcttgaactcctggcctcaagtgatccaccacctcggcctcccaaagtgctgggattacatgcgtgcaccactgtgcctggctgtaggcttgttttataagtctgggagtaaaatacttcttaaaattgtccaattagaatgagagtttaggctgggcatggtggctcatgcctgtaatcccagcactttgggaggccgaggcaggtggatcatgaggtcaggagatcgagaccatcctggctaacaaggtgaaaccctgtctctactgaaaatacaaaaaattagtcaggtgtggtggtgggcgcctgtagtcccagctacttgggaggctgaggcaggagaatggcctgaacccaggaggcagagcttgcagtgagctgagatcacgccactgcactacagcctggatgacagagcaagactctgtctcaaaaaaaaaaaaaaaaaaaaaaaaaaaagaatgagagtttaatgtttttatgcagtttagctcaggtagaataaagtgcaagaaaacattgaaccttttctgtgggtcaggaagccattgtagtaaagatcatgaaccctttcatcttcccctcacaaaataataaacaagggactgcaactttgagggaaatctagaaaggtaggagactggactttggagatgtcagattaggactggtgaaaagcagatattctaggctcctaaaataacgtgggaacaagcccagaacaaccttggacatggtgtgtttgtgcatgggatgcttttcttttgagacggaaggttgatgtgttgaagtcatggaaagtgttcaaaatattgtgagaattaccgaaatgtgacacagaaacatgaagtgagcacatgctgttggaaaaaaatggtgctgatctacttgcttaatgcagaggtgccaaaaaccttcagttgtaaaacaaaaaacaaaacaaaaaaaacaaaaaacaataataaaaaaaaggaaaactgcaatatctacagagtacaataaagtgaagcagaataaaatgcagtatgcccgtatgaaagattatgatgtcggtgaacaaacagttgtatgccttcctttccaatgtgtatgccttttattgatccttgttgcttaatcactttggctaggacttctagtactatgtgggaaaaaagggacgagtatgagcatccttgccttgttcttcatatgagggggaaagctttttaccattaaatatgttggtgtcgggttgtcataaatggccattgttaagttgaaatatgttcttatttgtttgtttattttaactagagatagggtttcactatgttgcccaggctggtcttgaactcctgggctcaagcgatcttcctgcttcagcctctcaaagtgctgggattacaggcgtgagcctttctgagcgttttttcatcatggaaaggatgtcaaattttgtcaaatgctttttgtgcatttattgagatgatgatatgttgtttatcttttatgctgttaatgtgacatatcacaattactgatttttgtatgttgaatcattcttgcatcccagggataaatctccttaatcatggtggtatgatatggatttggtttatttggccccactaaattttatgttgaaatttgattcccaatttggtagtattgggaagtagggcctcatggcaggtgtttggggtctcatgaatggcttggtgccatcttgcaatagtgagttctcatcttgcaagactggattggtttttggggtaataaattagttccccttggagtaggttgttacaaatccaggataccccttgggtttgttctcatttcacatatgcccgcctcaccttttaccttcttcaccatgttttgacacagcacaaaagccctcaggagaagcagatgctggcatcatgcttcttgtacagcctgtagaactgtggccattttaatgcggtattgaatttggttttctagtcttttatggaagatatttggatctgttttcatcagggttactggtctgtgattttctcttttttgtagtgttctggtttggctttgatatcagggtaatgctggcatagtaaaatgagtttggaagtggtccatcatcttcagtttttttgaagcaattgggatatactgacattaattcttctttaaatgcttgatagaattcagtagtgaagccatatgattcttgtgcctcagcctcctgagtagctgggattacaggtgtgcaccaccgcacctggctaatttttgtatttttagtagagtcggggtttcaccatgttggccaggctggtcttgaactcctgacctcaagtgatccactctcttcggcctcccaaagtgctgggattacaggcatgaaccactgttcctggcccatagacttctttttgatggagattttaaacaaccaaattgatatccttaatcattactggtatgtttagtttctccatttcttcatgctttggacttggtaagatatggtttctaggaatttacctacttttttaggttatcttttttatggcatataattgttcatcatagacccttatggtccttcttatttctgtggtattagttttcaagtctccactttgatttatgattttgtttatttgagtcctgtcacattttatcttagtccagcaaaaggtgaattttgtatgtcttttaagaaacaactcagtttacttttctgttgtttttctagtccctacttcatgtttttcagctctgatctttaagatttccttcttctttctaacattggagtttgttcttctttttctagtgtttgaggtataaggttatcttacttatttaatatctttcttttttcttcacgtaagattttatcactaaaagtttctctcttagaattgcttttgctgtagcccataatttattatttatttatttatttatttatttatttttgggatggtgtctcactctgttgctcaggctggagtgcagtggcatgatctctgctcactgcaaccttcgcctcctgggttcaagtgattctcctgtctcagcctcccaagtaaatgggattacaggcacatgccaccatgcccagctaatttttgtatttttagtagagacaagatttcaccatgttggccaggctggtctcgaactcttgacctcaggtgatttgcccaccttggcctcccacagtactgggattaaaggcatgagtcactacacccggcctagcccataagtttttgtatgctgtgtttccattttgatttgtatcaagatctttttaaatttccctcttggaaaatttaccacttaccctttggttgctcagaagaatgttgtttaatttgcatatatttgtgagttttccagtttttctttttattgatttctagtttcataccattgtaatcagaagatattcttcatgcagtttcaatcgtcttaaatttgttaaaacgtgttttgtggcctaatacttaaagtaatttggaaataattttatatgtacaagaaaaaaagtcttctgttgccttttgacagaatgcattgtatatgtctgttaggccctctttttgtctaaaatgcagttcaattacaatattttctcattgactttctatctgaacaatttgtccattgttgaaagtgaggtattaaagttttctactattattgtatccagtctgtctcttccttcagatttattaatatttgctttatataatttaagtgctgtaatgttaggtgcatatatatttgaaattgttatatcccctgatgaattgacctgtttatcattatatgatgatcttctttgtatcttacgagagtttttgacttaaagtttattttgtataaatttagctattcctactctcttttggtttccatttgcatagaatataaccttccttatttacattgactctaagtgtgttcttaaagcttaagtgaatccgttgtaggtaccatattgtgtgtgtgtgtgtgtgtgtgtgtgtgtgttcaatccattgagcagtctatctttagagtatttaagcaatttatatttaaagtaattattgataggtaagcaattactattgccattttgttaattggtttctagttgccttgtagattctttgtttgtttcatcctctcttgctatcttcctttgtgaactgatgatttttttgtaatgagtggtatgctttgattcctttctctttttcttctatatatcaactagaggtttttggtttatggttaccgtgaggcttacaggaaataccttttagttataaaagtctattttaagcttataacaaattttctttgatcacatacaaaatctctatacttttacaccccttattttttgtttatgatgtcaaaatttatatctttttaatattatgtatccacagactattgtatttacagttttgttaatacttttgtttttaaactttaagtgatttacacaccattacagtattagaatattctgaatttattagagtattagaatattattagagtattctgataaacttccatttgtcagttttatactttcatatgttttcatgtcattaattagccttgtttcattttatcttgaagaactctctagcatttcttataaagcaggtctaaagtggtgaactcctcagcttttgtttgtttagaaggctttagatctccatttttgaagaacaacttttttaggtaaaatattcttggttagcagtatctttctttcttttaccagtttgaatatatctatataattctactatcttctggctgtaaggcttctgctgagaaatctgctaatagtcttatcagagtttgcttgtatgtgccaagcctcttttcttgttgctttcaaatttctgtgtcttcaatttttgacaattcgttatgcaggtgaaggatcccttatctgtagtgcatagaatcgaagtgtttcagatttcagattgttttagattttgaaatatttgcattatacttaccagttgagcatccctaatttgaaaatctgaaatctgaaatgttccaatgagcatttcctttaagcgtcattttagttctcaaaaagtttcagattttgaagcatttcagatttcaggtttttagattagcgatgctcaacctgtaatgtgacttgtgaggccttctttggattgaaccttattacagattgcaagctttgtatacctgaatgtccaggtttctccccagactttggaagttttcagccataatttttttaaataagctttctccgctttctgtctttgttcttcttctagaacatccataatgcaaatgttagctgtcttgatggtgttccactaatctcatcggttttcttcattccttttcattctttttaaaaaaaattttccttttctaactggatattttcaaatgacttttcttcaagttcacagattcttttttctgcttgatcaagtctgttggtgtttttattgcattttttgaattccattcactgtgttcttcagctctaggatttctgttcagtttccttttcatgatttctatctattcattggaattcttttgttgattcctattttctgttttatttagttgtctacctatgttttcttgtagctcactgagcttcattaaaatagttattttgaattctttgtcaggcaatttgtagatctcaatttctttgggaaaaatcaagttttcttgatttttcatgtttcttgaagtcttctgctgctgtctttccatttgaagaaggagtaacttccttcagtttttacttactataaataccttcaccaaccagattggttagtgattatgaggctctctcagactttttctgtggattcacccactccacacttcttatccattttgggggagggaaatgcttaagattatacactttctttcaatcttgcaaagctaggccagggctgagagcttcctgttttgattttctagagtggtgcactgaaatgctcaagtttgtgtgtcttcctccaaccctgcatagttgatacagatacctgcatgaagtgcttgcatttgctgttcacgcaggtgcatttagggaaccaatcttgggagcgagttgtgccaaacattttgagtgcccatgcaccagttcagggggtccaaacacaatgtgttccaagtgccttatagatgcacttcctgatggaatcacagagcagtaaattagatccccacctctcttccctgtcactgttctcttccaaccactaaaccataccaatcaccattgtagtttggataagatgagaaagtgggtgtcttgttcagtatcctacaaagctgggggagctgggcactcatgaaccatgcttgcactctccccacccaccaggagaaatcatggactgcaatgatctctcttggcattgagctatgatgccttggaggaaaggtaatgcaggtaaagtgaaactgtttttcttatctttttcagtgcatctattctcagatttttgttctgatggcgtgctaaaactttatctgctggattcttggaccccacaaaagtgctcttatagataattgtcaagtttgatgcttctgctaggcgataatggtagaacgctcttattccaccaccgcgtgaacatcactctgctttctctcttaattctgccttattctgcacattagcctcattttcctccttggagcttgtgaaggaattgaagatgccagaggcatcagtcttattttatgtaaggatgctcctaaaccactaatgataggacctaaaatctattgttgaagattctgagatatactctccgtcttttagctgatgacctcattcagggccatcacagcttacaggccaaactgtctactaaaaacattaggaagtgttaatcacatagacctcttctagagctgtgcagtgtgtgaccggcacagccatatgcattagccatgataccccctacttcatcaagatacagcagtaatgatatttagtgtctcttatcttttctacaatacccttgaatacctgccatcctacatatattttatgaaatgggagactgaaagaatgtattttcaaagtaatacactttatgtaatatgtggtttttacataaacttatttatggaaaattaatgaattcagtagtaggttttgacattttattattttatctggtaggaaaaagtccttctttcttaaataaggacttaattagtccttatttcttaaggcctggatttgcaagattgctttcaaaattgcttcatgcatatttttatattttcaattccatatgaattttaaaatcacctttcaattttattgtgcttgtatgaaagttttgggttaacttcaagacagctgacttttaacagttaaaactttccaactaaaaatgtggcttttctctcaaatgacaagctttgtataatttcttatagcttcccttcttgttttctcttcaaaagatttttagaatatttttgttatgatattatctttagatgaaggtcaatttgtatcttcttcttttatatttttagcttggtgggccttttcttgaagacacttgtctttctttaacattgaaatacatttatccattgttttaggcaatttgtacctctccattttctttgttctctcttttgggaactcgttttagtcaaactttgggcttcctgctttgatcttcattaatcctttagtctttgttctagtgtttttagtgtctgaagtactttttaaggttatccatctgggtatgctagagaatgctggtctgggtatatgttttacatgggcatatgacagaatcagcattacctcaaatggtcaagctgcctttcctgtgttgaggacacagagtttttacctggaaaaagtatggagacagaggagcaagaggagcctgtgctgagcactttctgtttgcccctccagacttacagttgacctttctcaattcacatctgccctttgggaggctgaccatatctgtgggctacttcatctttgggctttctgtggtgccctggaagaaggtaagagtgtggggccgtaacattggttcctcccactctctctccacgtggacagcccaactgcctcctctcaggcctccctctctgccagacctctggcgctggctttctgcagttgctccttcccttgcccttttggacccagaggttgtaattataaccccagcgtcacctctcaggatactgtattatccatccctgtgattttcccaccctggcccatacttgcgtaaaagtccttttattattctcaaataatttaaattgcatgttccatgtatttcctacaggtactctgaaaaatataaatgcccgtaatcccagcactttgggaggccaaggcgggcggatcacaaggtcaagagattgagaccatcctggcctacatggtgaaaccctgtctctactaaaaatacaaaaattagctgggcactgggctggatgtggtggctcgcgcctgtagtcccagcactttgggaagccgaggcgggtggatcatgaggtcaggagttccaagaccagcctggccaagatggtgaaaccccatttctactaaaaatacaaaaaattagctgggtgtggtggtaggcacctgtaatcccagcaactcaggaggctgaggcagagaattgcttgaacctgggaggcagaggttgcagtgagctgagatggcgccactacactccagcctgggtgacagagtgagactccatctcagaaaaaaaaaaaaaaaaaaaaagggtggcatctgcttgtagtcccaactactcaggaggctgaggcaggagaatcacttgaacccaggaggcagaggttgcattgagctgagattgcccaccacactccagcctggcaacagagcgagactgtgtctcaaaaattaattaattaattaattaattaattaacataaacaacatgtaatagagaggttcaataaggccaaaagtggttcctttcaaaatttgaatgtaacataccaacactgacctaagacatattagacattaataatccaatggctaataagaaaatacattttttttttttagatggagtctcgctttgtggcccaggctggagtgtgcagtggcgcgatctcggctcactgcaacctccaccttccaggttcagccagtcctcccctctcagcctcccaagtagctaggattacaggcatgcaccaccatccctgacaaatttgtttttgtatttttagtagagacggggtttcatcatgttggccaggctggtcttgaacccctgacctcaggtgatccaccctccttggcctccgaaagtgctcggattacaggtgtgagccaccatgccaggcctagaaaatacatttttaaattaaaaatattacttctgcaatatctccagacctagaggcttcaccagtaaattttgctaaatatataagaaagaataataccaatcttattactcatgaaattgataaataccagtgagcttgactgaggaaaaaggggcaaggacacaaccaatgacagaaataatacatggaattcagtatagtcttctaaaacattacataatggtaagacgatgttatatacaattttgtatcttgcatttgaaaatgtatatgaaaaagacatgttcctagaaaaataaagctcattagaactcacactttatcttcctcttctctctctgtttctttgttttgttttcttttgttttgtcttctttcactcagacatataggaggtccaggcagcatgaacagctccctggtcagagacacatggatttgctcactggttactcaaagctgattcaaagccgattaaagctgctgcttcatctggggtcccaacctccagtgggaaaaacattcttcttttcctgctggtgtcacccactgttccacggatccaaaacaacacccaatgtttggtacaaatttagtgaaacagctctttccattcttaactcatgccaagcatctcagcttggggtcaggaaaatgccaggggacatgagctcttctcctagagttagagaattctctgccttagttgcaataaaggaaaagatacacattcttcctacaaatgccaaagtaggctcaaaatttggttcctagagtagagtattgaagtcgtggcaaagatctttccagtgatcaaagcagtggctcgttatgttccctcagactgaagctacagtctcatcttcactttctgttagctccctccatcctctgcgtaggcccacacctgcttcttacagttgtgtggattatagcacctcctctccagcctcaggacctttgtgagtgctgctccttcttccttgactgctcttcaccagggatcctcagggcacagcccttacctcctgcaagtcttgacttaaatgtcactttctcagggaggcccacactcatcaccatttcacacccacctcccacatgaccttattttacctgttctctcttctcctcttttttttagagtacttatgatctcatgtggtacattttggggtttttggttcttctgtatccgccactgccatgatcagttagaatgttggaaaccaaggaaacttggttttttggcctgtgatgaaaactatggggtctaatagtatctgataaagtggcagaccctcaattattatttgctgagtaaatgaatgaaggtgtgtagacaactagctctagaagcttaaatgagtgataccatgttttataacattggaagaggccgggaatggtggctcacgcctgtaatctcagcattttgggaggccaaggtggatggatctcttgaggtcaggagtttgagaccagcctggccaacatggtgaaaccttgtctctactaaaaatgcaaaaattagctggacgtggtggcacacgcctgtaatcccagctactctggaggctgaggcacagcatcacttgaacccaggaggcagaggttgcagtgagctgagatggtgccactgcactccagcctgggcaacagagtgagactctgtctccaaaaacagaaaaaagaaagggggggaagaaaagaagaaggaagaggaaagggaggaggaggatttatcattcacttacactagaaacagtgaaaatagataatagctataatttactcacatcttatctaaaacacaaattcagggtaatttatgagcaagtcattttccggtgggctttcgatagtgtgtgaatttggaatgaatgctggtacttccagctcccttccacctgcagcaccaggaagccattgttgtggggaggccaccaacttggctggcatgttgcttctgcctcagttagtgatgatggtgatttggagagaaaggacactctgctaggctccaaatccaaaggatcaagtggataaatgaaatgaatatctaaataaatatcaattaggtcaaaagtttgttttcatctaaatgaaatctgaacactacttagggctatgaaacatagccagaggacatggccagctctggagtggggcctggacttgctctcccctgctggaagtgcttttcctcccagagctcagagcaccatgtgcgtgtgacccctgccttttcacaggccattgccacagggcatctccctggtccacccgccccaagatgagccagcctcccactcaggaagtgggtggggaagggaaagaaagacagaggagagagagacagtcacacacaggcagtggagctcccctgcacccaccagggagcttgagcagctcatctgcagagcagggaaacatttttactaccattgggaagacgctgagcagagaggtgaggggacagcatttcttgtctccctgtggcttgttccactcacagttcagtttctcctgttcttggggaaaaggagggaaactgtattagtcagggttctacagagaaacagacccaataagatgtgtgcatgtgtgtgtgtgtttatatatgttcacagaatgtatatatgtgtatatatatgtatatggataactgcatatatatattatttatagagagagagaagagcaggagacagagataaagagagattcatataaagaattatattcataatttatataataatttgttcctttaatcataaagtctggcaagtccaaaatctgcagggcaggccagaagcctgggcaccccggaaagagttgcatctagactctgaagacggtctggaggcagaattccctctttcccagggaattccagtctgttttctctgaaggcctttactgactagatgaggcccccacacacatggaaagcaatctgccctactgaaagtctactgacttagaggtttagctcatctaaaaaataccttcgtagcaatttcgagactggtatttgaccaaatagctgagtaggttggcctagccaatctgacacataaaattaactatcacagaaacaaaataatcaatataggtaataactgtgccagaatgctgtgatgtttcaggatgaccttgtttacatttacatttattgtcaaaacttaccttctctttttatatgggcaattaaatctgctactgagggtatcaagtactgatttaatttacaatcttaatagataagataggttcctattttctcctctccataaaagtaataagtttggagaaaccaggtcggaaatacctctccagattttaaagcataacctcttgtttggaataataagtatgtaaataagcaccataaaatatgaaaccaaacatttcatcattcttttatatacattatcccttgcatttttaaaaaataaggaacaccttattagccatattttcaaatggtgaaaccaacacccccagctcagactctgccgtggtaggctccagggtcactgataccagatcccatggtattttcactatatcccactctttctttgcatgtggctcttttttagctgcattgcgggtaaacaggtgtggctcttttcaaaccaattccatgcatatgtgaagaaaattgatcctgaagttccttttgccaaagatgcttatggagaagtgtctgtgtctggacagacaaaagtgtccatttttgcctcgaagcttggcaaaattgaaattgatgatggggaagctagaaatacttcagtctacatttcgaatcccagctgcggggaggctggttgaggattgcccatccctcagtctgggctggattctccctccagtctctggggttctcttttctattcacaagagggtgctaatgagatggtttaatctctataccctgtggtccacaaatacaagatgccagcgtggccaatggggcttccataagagtggcaatcaggggtctcaagcttaccatgacgttttgggccctggaatcagatcatagttctacagttgtcctggcactagaactcatgacaaggttgtgactagacagaaggagagaaggctggaggctgacaggaagcaatgtgaacaaatgccttcgcaggatgcatgggtttgggcaacagatggtcaggggaggtgctggtgcagacgggctcagtagcaaagcaataactgtggatggccattttatggctgcagatcacagcacatttataaaagatgtgtgtttcatgaaaatgtgcatttcatcgtggaaatactgtggttggaggagatttctcaaagctgataaataagtgtaggtgacttaacttgcaaaagatgatcatatgtgagaacggatgtctcaaattaggaaataacttgttaagtaaaaaagcctcatgtattgatttgaagaaaaagatattttggtgctcatcaaaataaaagtataataagctgaagggctgcttttttctgtaaacataattttgtatcaccagttttattttcaacgaggacttgaaattcagaaaaaaaattaaagcagagaaatgggaaaagggcaaaaaaaaaggacaggaaaataaagccagaaaaaggcaaatgagtacagaaaaaaataaagtatccactcaggttctggacactttgttagaactgagaacacacagatccagaacttcctagcagttagtgtaagtaggaaatatcactgttcatataattcaaagggtttttaagacccaaagaagcatagatatctaactctgagatctcacagttctctgatggttctaataaggaggacatggtatgaacaaattatgccttactgttcgctgaggttatatcaatgcccgaacatttcatccagcaaagcagtcacaactaaaaacaggtacatgatggttgcagacagcttctcagtagcccagagagtgagagctcaccagggcagaaggtccctgaaccagaggctggcagtgcacatgtgctttggtcagaggagaaggacaaccgtgccccacggggctgaggacccagtggctggaacaaagacatgatcccaatttttttgatacctactttctcactttgcctttgggcctccacggagctcctgtgcagctggctggaccatggcctatgtacaatggctgagtctacacacaatcagaaaagcagcctgaaactctgtggactgtgtctgctttattctcagcaggattaatgaccctcattgaattcccatcgcctcaaagcttggcaaaattgaaattgattatggggaagctagaaatacttcagtctacatttcaaatcccaacataacctgagtaagggaattgcatgcttttctcatcgaaagctcaaataacttagtaatggttcaaaattgtctcctactggcttctcaatttagcacactaaatggtcttagagatcattgctcatctttggactaaggcaggcacagtaatacatgttcattcttttggcctgagctattacagtagcctcctaataacttatcttcatcatcctcttttcactcattctatactgggcaccatgtctgatcatttttttttctgatatttggatcagttctattaaactgataaccctgtgatgtctttttttcccttcaatagatctttaaattccaatcctcaccctaatctactctttcccaatatagcaccgttattcacactgctcccaaaatctattccatcctctgacttctcacaatttttttttgtcctaagactccatgataatagagaaaagaattttggtcttcacagaatgtattgacttaatgatattccaaatttctcttgggtgtcaaatatattcctcaccaaatatgactgaaagaaaactctattcaccatgaatttaaggatctcaaaattataatatcttctccactctcataattccacagcccctgctgttactataatgacctatattgcaaaagagtgaattcaattagagtccaagaggaaaactgctggtatttttttcatcttttgccatcccatactttataaagtgcagttagaccccctgtttgcctcccagcataccaaagttatgtagattattttaaataaaatctactgaaagcatgcatttttaagtaccccttttgtgtcccctaaattacagaggataaaaccagccatagaggcaaattcctttagaccttctcctagaaacaaacactatccattacataaaaccttcaattgcaaggacagttctgtaaaccatgatatttgatcctggaagcttcctagattgaacacaaagaagagggtacagtatttacatacctccagctttaagctgtgtgcctggtgtttttcactccaaggtggttgagcatctccctctacactgccatctaccccattcctcatcacaaatgtcaactctgtctgagctgccttccaaagtaagcagagaactcaggactgggaaaccagatggggctggcttgggaagtgtggcctacctgttccctccatgaccaagcacaacactgtatgtggggaatgaaatgggaccaggtcccagagtactggggaaacagaacctcatatccaatgaggagttcgggcaggcaggtcaaagatggacctgagaccaactcactgtgatgggtgtcaacagaaaagaagacatggcctcagaagagatgctccctgagaagctgggccactttctcatgtgactgcagagtaatccatccctgcgtggagctgacaaggcaccaagctgctgggcatgagacccttcacatatcctctctgatcttctcgattagctctgaagtctctctggtttgaaacctcatgtcacttttttggtatgtctctgtggcattggacatcttctgcctcatattagatgcattgtgtagtgtttacttatccctaatttgcagccgcttatctgagcatagacactagaccactccatctttgcctctataaatatcaggtgtaggacctcgtacttgacaggtgctcataagatatctttctctccctttttttttttttacttgagttcaagtgatgagggtctagtaataggtattgctaagcagagcaaattcaaataattgtttagaaaagtattgatgactgtatctgattaagagtataaaaaatgggggaggagctatgctgagcccccaattttaagttagagacaggagaattctgatgcctgccacaattgatatcttataatgctgcatttgcaagcttaacattcaatcgtttttcatttagagtccaaagcaatcattgaccatggtgcctgggtgttggctgtgaagcctgaattctaaaacacaattgtaaacgtattttgccttatattgagataagcacatacaatacttaagacatgcaatattttaaagaaatacaaaaaaattgctaactggccacatcagttcttaacttttttattaaccagaactggtttcctcttgctgttagttccagaagaaaagattaaatcagaatagttctatatgttttaccttgtgtattaggtatcaattgttgcacaacaaatcatccccaaacatacaggcttaaaaccaccattagttcacagtttctgtgtgccaggaaactggatatggcttggatgcatcttcagctctgaatctctcacaaggtcaccatccagctgtcagctcagactgtaatcttgtctaaaggtttaattgagcaaggagccactcaaacttaactcttgtagagttggcaggattcagcccctttcaggttattggacagagggctcagctccttgctggttattagctgaggccacctcagttcttgactctgtgggtctctccattaggaagctcacagcatagcagctggtttccctcagactgagcagagagcaagagagagtgctcaaggcaaaagacactgcctttttgtaacttaatctcagaagtgacatctgctgtgttctgtatgttagaagtgagtcactaagtccagctgaaactcaggggagggcttgcctaccaggaggcaggaatcaccaggacccatcagagacaccgtctaccccagtctgtgctcgggtccttcatgtctctccctcctgaaatttgatagattctgcaaaagaaaaagccttgatccacgctgctttctagaatgttgtagtgaaaagcaagtcagtgtggtacattcagagtaattttataattttataatttaaaaataattgacattactcccagcattaccaaagttgccaagatcagcttttaaatgctcacttaggtcatttgtgtttaatgcattgagtgtgtgctcaatcttcatcccaagacagagggattcagataactggcaaatgatatgaaggaaaacctttctggagtagtccatctggaggccacgtcaggactagcctcacaggtagagtacaggcattctgactttgggagcattaaaaagagcatcaaaccaaattatctgattcagccctatataatagcctacataagccccaaagatctctattttaaattagaaataaagttaatgtttcacttgaacattctgcaggaaagtggtatgagatcaaggtattattaactattaacaactggctgggcacagtggctcacgcctgtaatcccagcactctgggaggctgaagcaggtgaatcacctgaggtcaggagttcaaaaccagcctggccaacatggcgaaaccctggctgtactaaaaaatataaaaattagctggtcatggtagtgtgcacctgtaatcccagctactcgggaggctgaggcaggataatcatttgaacccaggaggtggaggttgcggtgaatcaaggttgtgctgttgcactccagcctgggagatgagtgaaactccatctaaaaaaaaaaaaaaaaccgaaaaactattagcaacttagcatgaagcactctgtcacctgataagaactgagaaagtgtagcacaggacagatcaggtttgtcttgatggaagaaaggaaagaggaaattactgatggtaatcttgagccgagcacagagaaaggcaagaagggatggctctggtttcaaacaatccatgtctgattcctcccaagcccattctttgttatctattgtaatgtcaatactcatattaggtagggagttccctttaatgacctctaaggattctttcagctggaagagttgtatccattcatctgctaatcttcttcatcaaaggacagttggaaaggatgcggcattactccttacaagaaggtggaagtctaatttttaaactatgagcttttaccttaatgtgagccatttctttttaagctaggcatttacatgtactccaatataattccttagtagaatacatttatttttggtgcaaaacaaaattatttagtccagagacacccttcactggcaaagaaagacattcattgtgcagtgcagtaattcagagaaatattacttccaagtctttttaaagttaaagaagaatgttttagggcccatttgaaaagtgctattcatatgaacttgaaggtcattactcacagataatattcaggagaactcctgtctaggctgagagcagccacttctgtgctgtttcaagttttcagaaaccatggtactgttactcctctataaggtagaaaaaccatatctaacatatttgatttattccaaaaactcagcaaaatcgatttctttttcactctttggaagaaagtacagaatgaggaaaatcacttcttaaaaaattcatcaaaataactatgttaagcccttatgatttccaggccctgagcccggttctggagtcatagagtttagaagaaaaagatggaaatatgcaatccagtgggacttcctttatcaaatgaacgcaagggcctgatttctttggtagataatgcgttcaactaaacggatctctttgagatgaggatattagctgcgctgcactgtctgtacaattgtgtctgtacctggaggagtttccacagcagcagagcctgagattctatgcattttagatttagaaacctcattataccagttcctacaagaataggtctctgaaaggacgaatctcacaaatcaagctcataaaaaatgcataaacaatgcttacatcatttataatgagaagatgttcattcccagcaatagggcagagcagataattgagtatctccctagtgcagaacattcagaagtactggatactgtagcaaacagtttcaaatggagagctgaaattccaacaaagtcccaagaccacattttaagacgaatctgcaaaccagaactgtaaagcacatgagtggacctcactgacatctttgttttatagtaggaggtggtgctctgggctgcatcaggtagaaattagacctagatccacagtaagcctgtcctatatgctgacactgcccctccctcccagtaagccagagactagaaaaacattcaacctcctgtgggttcagagaaacaacagagagcctgtttgactgatcgcaggttctaggtggtaaagtctcccctaagaatttataggcaaaggctgatgcctccagtgtattcacgtgtgaattcatgctctccttgtggcttgggagtggacaaagtaagacactgataggaattgtttcctggatggtaataccactgtgacattgttgtgggaagcaagctctgagacagagactgacatgcaggagagggatgagggaatgctcttggaatctccacctggaagtgaggagtagaaagcaggactgggactgggccgaggaagagggcaagactcagccagccttgcagggagttctaaagattacgtggctcttaagaattatctggagtagggcgagaggcgaggcccttagtgctccaagtgaatcagtctcgggatgctctgggagggggccatgaccttgggtggtggggccatgtcggaagggctggcacctgactgcactgtcagatggggcaggcagtaagtccttactcctgaaaggactgtctgtccagggcttctgctggcagcactgtcagtctcggggcaataagccctttactcctgaagggatatcagggtggccatcactgtgtcaccacagggttctagcagaagcaaacacaaggcagctgtgaagggcaggccctccacctaggattccagttgacccatctagcaggataaagatagaaaatgatggcagttctcgtaactacagcataattaatttcagatttaaaaaaccaggtgaagctaaaataccagattttaaataatggaacttgaaagggagctgattagaattcatgaatcctaaggtctttgaattatcctggttaactggtggaattaaaactgtatagttaactatatgtattaaaatatgaaagggaatcttcaaaaatagggaaataaaatgtatagctctccagcaagatactaaaaagcaaaaacagaaaaatgaacataatacatagcatataataaaaagaatggaatacatctaaatgtattggtaaaataataaatataaacgatcaaaagatgtttcttctaaggcacaaaattaacattatctgccactttatacgtagaatctggaggaccttgaatagcctaactataatacccctacccaccctgctccagtggcaggtccactagacaaccttccttatcatgggtggcagagcccggaagcaagtgtcactccaccctcttgttactacaaagcctgactccctcagctcctgcttgttcactctgtttccaagcgcagccctcatgtggccccacatcatgtggttccatcctcccctgggctgtgtgtgcctgtgactaataagctggtgtgaactcaactgtctagtgttgggtgtcatgtgtccagtcatttccataaccccagtgtgggaatctctcctccacaaatgggatggagacgagatgaatacatgccaataaaaagacatagatattcgtattgaaatattttataacagaaaaatgttgagagtaaacatgtgtatagtatagggaaatagacatattaatataaaaggaaggaaaatatatagcagacattttctaatcagaagaaagccaccatggtattattaccatccagaaaaataaaccatacagtaaaatgtatcattaggaataaatacattcagtacatgagggtcaagtattcaactcctcagaaatagacaacagtttttgtctaaacctaagaacataatatcaactatgcacagtcagaacttcatgaagaaattggtaagtaaagtgatcacatatttgtcaagtgtgtcaatatttaactgcaacaaataattagaaagtacatattctcattcactcatggaacatttataaaaatgggctatgtgccataaatacaagaaaattttcaataaagatatgcagacgttatccaattgttcttcagtcgtaaggcaatgcaattagaaatcaaaataaaaaataacaaaaaagattgtatgttaatattttaaaatcctcataagtcagtcaaataacaatttttatttgtaatcataagaaaacatttgtattagtaatatattgttgcataacaggtcgcccccctacttagtgatttcaaaaacaataatctttgatgatctctcatttgtgggtgggtcatgtacttaggagcagctcaaatatatatttctggtttgggagctctcaggaggcttcaggcagatgtctggggtaacggccatgtaaagacttgaactggtcggcggctccgctccgcactgccgggcgccgcctcgccatggacgcgcgcgggggcggcgggcggcccggggagagccccgccgccgccgcgcccccccaacagcagccgccccgggccgaggcgttgcccccggaggcggcggaggagggcggcccgcggggccagcgccgcagccgcgacagctagtgcggcagccccggcatcccgggcacggcgagcacggccaagggcagccggaacggccgagtgcgggcgcggctagccgcagtgcagccccgcggggcccgagggcccggcgcgggggcccaaggtgtagttcttgtgccccggggcggcctcggggcccgcgccggggccggggccggggccggcggaggaggccggcagcgaggtggcggcccggcggcggagccgcgccgcagccgggccagcttcatgcagcgccacttcggcgcgctcctgcagctgggcgtcaacaagttctcgctgcggatgttcggcagccagaaggccgtggagcgcgagcaggagcgcgtccagtcagcggggtcctggatcatccacccgtacagcgacttcaggttctactgggacttcaccatgctgctgttcatggtgggaaacctcatcatcatcccagtgggcatcaccttcttcaaggacgagaccactgccctgtggatcgtgttcaacgtggtctcggacaccttctgcctcatggacctggtgttgaacttccgcaccggcattgtgatcgaggacaacacggagatcatcctggaccaagagaagatcaagaagtacgtgcgcacgtggttcatggtggacttcgtgtcctccatccccgtggactacatcttcctcatcgtggagaagggcatcgactccgaggtctacaagacggcgtgcgccctgcggatcgtgcgcttcaccaagatcctcagcctcctgcggctgctgcgcctctcgcgcctgatccgctacatccaccagtgggaggagatcttccacatgacctatgacctggccagcgcggtgatgcggttctgcaacctcatcagtatgatgctgctgctctgccactgggatggctgcctgcagttcctggtggccatgctgcaggacttcccgtgcaactgctgggtgtccatcaatggcatggtgaaccactggtggagcgaactgtattccttcgcactcttcaaggccatgagccacatgctgtgcattgggtatggccggcaggcgcccgagagcatgacggacatctggctgaccatgctcagcatgattgtgagtgacacctgctacgccatgttcatcggccacgccactgccctcatccagtcgctggactcctcgcggcgccaataccagaagtacaagcaggtggagcagtacatgtccttccacaagctgccggccgacttccgccagaagatccacgactactacgagcaccgttaccagggcaagatgttcgacgaggacagcatcctgggcgagctcaacgggcccctgcgggaggagattgtcaacttcaactgccggaagctggtgacctccatgccgctgttcgccaatgctgaccccaacttcgtcacggccatgctgaccaagctcaagttcgaggtcttccagccgggtgactacctcatccgcgaaggcaccatcgggaagatgtacttcattcagcacggcgtggtcagcgtgctcgctaagggcaacaaggagatgaagctgttcgatggctcctacttcggagagatctgcctgctcacccggggccaccgcatggcgagcgtgcgggccaacacctattgccgcctcctttcgctgagcgtggacaacttcaacgaggtgctggaggagtaccccatgatgcggcgcgccttcgagacggtggccatcgaccgcctggaccgcatcggcaagaagaattccatcctcctgcacaaggtgcagcatgaccttaactcgggcgtattcaacaaccagtagaacgccatcatccaggagatcgtcaagtacgacggcgagatggtgcagcaggccgagctgggtcagcgcctgggcctcttcccgccgccgccgccgccgcaggtcacctcggccatcgccacgctgcagcaggccgtggtcatgagcttctgcccgcaggtggcgcggccgctcgtggggccgctggcgctcggctcgccgcgcctcgtgcgccgcccgcccccggggcccgcacctgccgccgcctcacccgggcccccgccccccgccagccccctgggcgcgcccgccagcccccgggcaccgcggacctcgccctacggcagcttgcccgccgccccccttgctgggaccgccctgccctcgcgccgcctgagccgcgcgttgcgcccactgtccgcctcgcagccctcgctgccccacggaacgcccgtcccagcggcctccacacgcccggccagcagctccacaccgcttctgggacccacgcccgctgcccgggccgccgcgcccagcccggatcgcagggactccgcctcacccggcgccgccagcggcctggacccccaggactccgcgcgctcgcgcctctcgtccaacttgtgaccctcgccaaccgccctgcgggcccaggagggccggaggcggggccgtcatccagaccaaagccatgccattgcgctgccccggccgccagcccgcccagaaaccacagacaagacataggtagccgtagttggactgacgggcagggccggcggggcagccccctccgcgtccccggccgtccccccttatcgccctgcgcccactcccatcgcccctgcccccggcggcggcctcgcgtgcgagggggctcccttcacctcagtgcctcagttcccctagctgtaaaacagggacggggcggcccagtggctgagaggagccggctgtggagccccgcccgccccccgccctctaggtggcccgccgtccgatgaggatcgttttttaagtgcaatacttggcccaccggcttcccgctgcccccatcgcgctcatgcaataaccgacccggccccggtccacgcgcgtcccgcggtgaccttggggagcagcaccccagctccctccagcactggcaccgaggggcgggcctggttgcgccgggcgcgggggcgaggctggggtcccgccaccgtgatgaatgtactgaccagctgaggcagcagtgcccccaccgtggcccctacgcccaattaacccccacacccccattccgcgcaatgaacgacagcatcggcaaaaaaaaaaaaaaaaaaaaagacttgaactggagaacctacttccaaggcagctaactcacatttctgggaagtaggttctgagaagtccattccttcccacacaacctcctgccccagggctgcttgagtgtcctctcagggtggtggctgacttcttccagaaatgaagagatgtaagagccagggagagccaggcagaagttacaggtccactagacaacctacagtatggcaaattacagttgcctgtttcctagaaaaatttataccagctgaagtaattacaggagatagaaaactttaatggtcctacatgaattaaatgaattacatcaactcttgaaaattaactttgacaaagtaccaaagatgtgttgctaataaattctattcaaggtacagatacttctagtcttatatcatctgtactagagaatagaaaaagaaacagaaataaatatataaaaatatgtgagaataaagcattatagtccaagctcgtttatggagagagatgcaaatatcctgaatttaaaaaaataaagtatatactttactcacagaaagcaatatacctaaaattaaatctaacatagatatgcaaaacatttatgcagaagtaaatgtagcattgtctttcaacacagaaaataaactaaaaatgaatgagtagataggcaaagtttttgtatcagaggcctaaatattatgaagatatttaataattaaatgcaattcaaatataaataccagcagggtatttcattgaaaaaagttaaatataaaatttatatgaaagtgtatagggccaagaaaaaaaaaattttggaaaagaagaactgtgcagtaaagtgttaactcagcaggcctgggctgcccaaaccctgcatattccgaagggcttcaggacagtccctgacaggctcctggagataacctctgagcctttgtaatattctgtgtgatttgagtgactttgtaaacctgaagctttgggtcacaccacatgctatcaacatgctttatagtgaacacctgtttatgtatgcctgggccttgggtcacattgtgtcactttgacctctgggggtggcagacagctgactggagactgagtggttgaggtcagtcatgtggagcacaactggaagcccatgcctcctccttagtgctggactctgctgtgtgcacctttttccttgctgcttctaatctatatcctttcactgtaattaacaatagctgtgagtctaacagctgtctgtgtcctgtgagtctttctagcaaatcgtgcactggaaccaaagtgggtgggcactcaccaactaaaactatcaaacctactaggaatctgtgaaaattaaagaacgtggcagtacatagacatagccaataggcaaaagagaatcaaaccttaagtgcaaagaaatgcattgcagatcagcaagtaagaggtaaattatgggataaagtgatccaaacactgtttattcaggaaaaatgtagatttttatcagacaccgtttataaaaatgtttcagatagattaaaacctaatagtgagcagcgaaattaagcatgtctttggaagaatgaggatcatgttcttgttctcaggatggggacagatttactaatgtagacaatcataagaaaataggtattataataatttgacaacattaaagttaaacatacctgtatgcaaaaagacaccataagccagcaaggattaggtatcatgtatctctaaccatgtgatatagctgacaggggcttagtatattcagattatacatcaatcaagttaattaatccattcaaacaaatccttattgaatgtctatgtgccaggccctgttctagtcaccagggtaactgtagaaaacaaaactaatatcctcccctcataggagaggcagacactaataaatacgtcattacatatgttgataaacctcagatttcagaaagtaccaaggagagaactaaagcaggtgggagaatagagcttcgtgagagatgggagatgctattttagattggctgttcataaaaagaataattttgaacccaatgggttatgtaaaaatcagtatagaatagaaaaatgacccaatagaaaaagacaattttcagccgggcgcggtggctcacacctgtaatcccagcactttgggaggctgagacaggtggatcagttgaggtcaggagttcgagatcagcctggccaacatggtgaaaccccgcctctagtaaaaatacaaaatttagccaggtgtggtggcacacacctatagtccctgctacttgggaggctaatgcacaagaatcgcttgaacctgggaggcggaggttgcagtaaactgtgatcttgccactacgctccagcctgggcgacaaagcaagactgtctcaaaattaaaaaaaaaaaaaaagaaaaagacaattcttgattgaatgaactgaatgcccaataaacatttgaaaagatctctgtaatgtatttaacataattttacatctctgttcatattagagaatttatggggtttttaataaaacacttggccctgagttgataatttttgaagctgggtgataggttaatggtggttgattatattattctcactctctgtctcactcattacacacacacacacacgaaatcatacatgatgatttatacagttacttatagtttacataatttatatatttaacataaatataagtataaaaataattattataaatataaattatatgaaaataatttataatgaattctaaggtaattaagacacaaataacaaattttaggactgaaacagagatatggccacagatcatacaggtattaaaaaataactagtaaatctatgaaaatctttatacaaaattatctttatactatgaaaatctttatacaaaaattgctgaaaaacagacaacttcctccaagcatatgatttattaaagtgcattcaaaaatataaagtcttcacaaccctataattataaaattgaatctgtaattaaacaatttgtcatcaagaaatgccaagtcccaaaggatttactgatgatttttaccaccaaacatttgaggaagaaataagaagtcatattacacaaatcattctagagaatagaagaagagaaaatactttccaatgagggaaagataatcttggtcacaaccaaaaccaaaataagagtatcggaaaaaataaaattgctcttgaattcttaataagttactctaaactcttgaaagacaatttctctcttgaatatgacttaaaaataaatccaagccaggcgcagtggctcatgccggtaatcccagcactttgggaggccaaggcaggcggatcacttgagtccaggagttcgagaccagcctggccaacatggtgaaaccccatgtctactaaaaatacaaaaaaattagccaggcgtggtggcgggtgcctgtaatcccagctacttgggagggtgaggcaggaggaccccttcaacctgggaggcagaggttgcagtgagccaagattgtgcaccactgcactccagccttggcaacaaagtgagactgtgtctcaaaacataaaactacaaaataaatccaaataaaaacattagcaaactgagtctagtgacatatacataaaggaaaatacatcatggtcatgttgggggccagggatacaagattagtttaacatatgaaaatcaatcaacataattctccatgaaaaaaaacattttaaaaaattgaactgtctagttatgattgttaaaaaagaaactatcactatattagaaataggaatacactttctaaatgtgagaaaggtgtttttatattgaatgaaaaaatgttgtaagagcattctcagagattagaaattaaaacaacaggatgtctgctcttaccattgttattcaacatgatactggaggtgctagtctgtgcactgaggcaagagatagccagaaaagcgtgtatcattttcaagtgccagaataatgaaaatgctcaaaaaagcaaaaaggatggggcatatcagagagatataaaagtgaccctgatataaaataaataacatggtattggcttacaacccaaagtataaaatcaatatacatgaggttacactgatataaataaatgattaaatgaacaagtaaatacaaaagaaagaagaaggacaactctttgtagaagaattccagataatatgaatagatactgtctcttccaggaattggaccttagtgtctacctcccaggccaccttgtgcctggcctggacttagtgattcacatgcaagactagagtattgaaagccgggaaagagtatctgtgtggtagagaaacctagcaaacgcctccttgaccacatgatcaaggtgaacatcaccagtaatgaggcatgttgatatcacatccccttgatatgaagtgatgagaaggaagcttaacctctgcagaattttttccaaaagctcataattccagcctaatcaggaaaaaaataatcagacaaacacaaattaaagagcattctaaggacctgaccagtaatcttcaaactgtcgatacacagtaacaaggagaggctaagagttggccacaggccagaggaacccaaggaaacgtaatgattaagtgccagatagtatcctgaactggatactgggaacagaaaaagaacgttggtgtaaaaacttagtggaatgcaaatacattactgttaatgaaaattcagaatttaatattggtttcttagttttggcaaacgtagcatggttgtgtaacatgttaactttaaggaaagctggataagataactctctttactttttttgcagcttttctgtagatctaaaattattccaaaagtaaaaagtttattacataaaagaaagaagtcacaaaactcttattttaagacttacatggcaaattaagtggccatgattaaacaagtcatattttttctatgtatgtatgtatttatttttaaaattggttaatttatacatatatatttttaaattttacttcaagttctgggatacacgtgcagaatgtgcaggtttgttacataggtatagaagtgtcatggtggtttgctgtgcctatcaacctgtcatctaggttttaagcgccgcatacattaggtatttgtcctaatgctctccctccccttgccccccacttccctacaggccccagtgtgtgatgttcccctccctgtgtccatgtgttctcattgtttaactcccacttatgagtgagaacatgcagtgtttggttttctgttcctgtgttagtttgctgagaatgatggcttctagcttcatccatgtccctgcaaaggacatgaactatatttactttttttttttttttttttttttgagacggagtttcactcttgttgcccaggctgggcaatggtgcaatcttagctcaccacaacctctgcctcctgcttcaagtgattctcctccttcagcctcccgagtagctgggattacaggtatgtgccaccacgcctggctaatttttagtagagacgaggtttctccatattggtcaggctggtcttgaactcccagcctcaggtgatccacctgccttggcctcccaaagtgctgggattacaggcgtgagctaccatgcctggcctatatttaattttaattgacaaaaaaattgtatgttaaaggtatacaaaatgatgttttgatatatgtgtacaatgtagaatgtttaaatggagctaattaatatatgcgccacctcacatacttattattgtcttgtgatgagaacttttaatatttactcccttagtgatttttaagtatacaatacattgttgttaagtacagtcaccatgttgtacaatagagctctttcagtcattcctcctgtctggctgaaaatttgtgtcctctgaccattatctccccatttcctcttctccctagcccgtggaaccaccattctgagctctactcttagaaggtttttagatttcatacgtatgtgagatcacgtgatatcttccttcctccctcccttcttccttccttcctctctttctctcttttcttttctttctttctttctctttctttcatctctctttccttcctttcttccttccttcctttctctttcatctctccttccttcctttcttccttcctttctccctctttctttcctttctttctttctttctttctttctttctttctttctttctgtcttcctccttccttccttccttccttctttcagacaaggtctcactctgtcattcaggctggagtgcagtagcgtgatcatagctcactgcagccttgaactcctgggttcaagcgatctttctgcctcagcaccctccaagtagctgggaccacaggctatatcaccatgcctgactaattttttaaattttttttttttttttgtagagacagggtctccctatgttgcccaagctggtctcaaactactgggctcaaatgatccttcctccttggcctcccaaaatgttggattgcaggtgtgagccactgcacctggttcattatttgtctttctgtgcttagcttatttcgtaaagaagtcaatattaaatattaaaagttattataaagatatattagcaagacagtatggtagggacataaatataaacacacataccaacagaacatgacaaaagaacaaaaccagccgcatgcatactcgatggagacaaaggtaacactgcagaatggtgaaggaagaacagtcattttaatgacagtgttggcttaattgagtattcatgttcaaaaaagaaatttgagccttatttcacatctcatagacacacactataacttccttgtggagtttaaatctaaatgcaataagtgagcaataaaaattttagaatatattctaacagattatattaatgatcttggtgtaggaacagattttttaaaacactatataggaaactttaaacataaaaaagattgataagttagactacactaaaatattgaatatatcttcaatgaaatacaatgtttaaataatgaaaacataaatcacagagtaggagagaatattttaagtatggcagcgaaggtcctatgcctagatgatataaagtgcttctaaaagccagtaagaaaaagactcaattaaaacattgggaaaacgtttggataggcacttcataataaaagagtattcaaatgatcaatgctcacattaaaagtggttcaacatcgttaatcatcaggaaactgcaaagtaaaccaaccaagagataacactgtatactcatcaagaggcctacattttttattttatttgcttacatttttactttagattcagggggtacatatacaggtttgttacaggggtatattgcatgatgctgaggtttgggcttctattgatcccgtcatccatgtagtgaacatactgcacgataggaagtttttagcccttctcccctctttttcctcttttggagtccccagtgtctattgttcccatctttatgctcacatatacccacaatatagctcccacttataagagaacacgtgacttttggttttctgttgatgcattaattcacttaggatggtggcctccgactgcatccatgttgctgcaagggatattattttattcttttctatggctgcatagtattccgtggtgtataggtaccacattttctttatccgatccagagttgacgggcacctggattccatgtcgttgctattatgaatagcactgcaatgaacatataagctcatgtgtcttttcagtaaaatggcttattttcctttgggcatacacccagtaataaaattgctggatcaaatggtacctcaaatcttagttctttgagaaatctccaaactgctctccatagtagctggagtaatttacattcccaccaacaatgtataaaatttcccctttctttacaacctcaccagcatctgttattttttgacttttaatattggccattctgactgatgtgagatgatatctcattgtggttttgatttgcatttctctagtgattaatgatgttgaactttttttttcatctgtttgctggccacttatatgtcttcttttgagaagtatctgttcacgtcctttgcccactttttaatggggttatttgttttttgcttgttgatttgtttaagttgcttatagatgctgctttgttggatgtacagtttgcaaatattttctctcattctgtaggttgtctgtttactgtgttgatgtttttttgttgttgtgcaaaatctctttagtttaattaaatcctactcaccaatttttgtttctgtaacagttgcttttggggacttggccaaaaattctttgccaaggccatgctaaagaaaggtattttctatgttttattctagcatttttacagtttcaggtcttacaattaagtctttaatccccctgagttaatttttgtatatgggctaagtgtccagtttcattcttctgcatattattaggcagttttccctgcaccatttgttgaatatggagtcttttccccattacttgtttctgttgactttgtcaaagatcagttggttgtaagcgtgtgaccttatttctgggttctctatactgtctcattggtctatgtgtctctttttgtaccagtaccatgctgttttggttactgtagccttgtggaatagtttaaagactttaccaaaaaactcctagacctggtaaatgacttcagtaaagcttcaggatacaaaatcagcatacacaaatcagtagcatttctatataccaatagtttttaagctgagagccaaatcaagagtgaaatcccattcaaaatagcaccaccccccaacaaattaaaatacttaggaatacatctaaccaaggaggtgaaaaatctctacaaggagaactacaaaacactactcaaagaaatcatagatgacacagaccaatggaaaaacattccatgctggtgtgttgaaagaatcaatattgttaaaatgtccatactatagattcagcattatttctatcaaattaccagtgcaatttttcacagaattagaaaaactgttctaatattcatatggaacccaaaaagagccaaagtcattctaagaaaaataaaaccagaggcatcacattacttaacttcatgatggctaaaatttaaggattgacagaaacacattatattactggtgtaggtataaattattaccattaatttggaaaactattgacagtatgtcagttttgaacaaaatcataccctatgagttagcaactccacttttgggtacacacccagaacatgattatcaaaaggcatccaagttttatttcataagcacctaaggatgtggatcaaaatgcaaatctgctacacaaaattagtagccagagggttcttggtgagtctggaagcaaagcacagcattgctttttattactcagccgtcatggcccagttgcctttggcaggtgaggccagctggccagtagctcagatggagcaggtatgagggggtaagagcagtggtccatctgtcactggagaagcctagtcacctgggcagaatatcttgaacctaggataagttcatccatggtagaccaactctgtgatggagttatgagatggggaaggagggtctggcaccatgcaacaggatttcccccaaagctcagcactccaaggagcacatcagcatcaggaatgtctgctggaagccagcggctgtggaggaggggcagtagccactgagcctaggttcagagcttcaatccccttcagtcctcttgactggcaagagaacagcagagtctattagagaggaattaccattccaagcaagaatttaggccacatctttcagaatgagaccattgagttgaggtccacttagcagggaaagtggcttcaggttgtggttgactgtttaattacaccctgctgttcactctcttcaccattgtatgcaaagtacagcgtctctgacaagcaaggaacactggcttgccccacagtggctggctggggttgatgaaatgagcagcgaagtagcagtgtgcccagtccaagcagagactacctctagcaggggcatgacattccccaagagagggcatctcctttagcctggaccttggagcaaaagcaacccatggatcagaccaatagacaacatgcagccctcatctaacccaagtggaatatagctgttggtataagcccccgagattttgaggttgtccccacaggaaagcaaactagcataacactgaattgctgagcaagtgggtggttaattaatagctctctttcccaactagagcttccctgaaagtccgaggaggcctggagcatgcagggagaggacaagcagcctcggagagaaagaggggaggtacaagtgacctggatgcaacacggcctggcccaggaggaattggatactcttaagggatatttcacacaagtcatatgaatctggaagactaccccagatccatataggtatataggacaaggccagactactctctatccccaacatgtctctcaactggagagtactaataaatactgccaattcttactacccaattcctgttttaatcagttataaaatacaatttagtatattgccgtggatttttatattggtaatattttcctaaggtggcttgccaattatcccagccccatttgttgaatagggtgtcctttccccactttatgtttttgtttgctttgttgaagatcagttggctgtaagtatttggctttatttctgggttctctattctgttccattggtctatatgcctgtttttataccagtaccatgctgttttggtgactatggccttagggtatatcagttgatacctccagatttgttctttttgcttagtctttctttggctacgtgggctcttttttggttccatatgaattttaggattgttttttctagttctgtgaagaacgatggtatgttttgatgggaattgcattgaatttgtagattgcttttggcaatacggtcattttcacaacattgattctacccatccacgagcgtgggatgtgttttcatttgtttgtgtcatctgtgatttctttcagcagtgttttgtagcttttcttgtagaggtcttttacctccttggttaggtatattcctaagtttttttttttgttttgttttcagctattgtaaaaggggatgagttcttgatttgattctcaggttggttgctgttggtgtatagtagagctaccgatttgtgtacaataaatttgtatcctaaaactttgctcaattcatttatcagttctaggagctttttggagaagtctttggggttttctaggtatataatcatatcatcagcaaacaacaacagtttgacttcctctttagccatttggatgccctttatttccttctcttgtctgattactttggctaggactttcagtactgtggtgaatagaagtggtgaaagtgggcatccttgtcttgttccagttctcaggaggaatgctttcagctcatcccccttcagtattatgttggctgtgggtttgttgtagatggcttttgttaccttgtgtcccttctatgctgattttgctgagggctttaatcattaagggatgcttaatgtcaaatgctttttctgcgtctatcgagataatcatgtaatttttgtttttaatcctgtttatgtggtgtattgcatttattgacttgcatagtgttagtggctctttctgcatacttgagaatatctagttttatgtctcgtttgaatctgggtaggttacttaaccatgatgacagttcattattatattttattttaaaaatgtattttttaaattttaaaatatttaattgacaaagattgaatatttttggtgtgcaacatgatgatttgacatatgtatgcattgtgtagtgattaccaaaatcaaattaattaacacatccatcaccacccatgctgtatatgagaaccccagaactgattcgtcttgtaactgaaagcttgtattctttgtccagcctctcacccagtttcccctctcccccacccctggcatcaccatttaactctctgcttctatgagtttgacacttttatttatttatttatttttgagacagatttttgctcttgtcgcccaggctagagtgcaatgtcacagtctgagctcactgtaacctctgcctcccgggttcaagtgattctcctgcctcaacctcccgagtagctgggattacaggcatggcatgtgccaccacacccagctaattttgtaattttagtagggatggggtttcaccatgttggtcaggctcctcttgaactcctgacctcaggtgatccacctgcctcggcctcccaaagtgctgggattacaggtgtgagccaccatgccctgcccagtttgacacttttagattccacacataagtgagatcatgcagtatttgtctgtctgtgtctttctatgcttattttatgtaacatgtcctccaggttcatctgtgttgttgcaaatggcaggattttctttttatggctgaataatagtccactttatacttcaaattcttcctatctttcagaaccagatccaatgccatctcttccgcaaagccttctttgatcttgaagtttggcagaggaagttctccccactgtgaggtttaattatattgatttcctcctggccatgggtctgtttgtaatagggatttatgcaggagatagataaggtttctcatgcagcttgtcagctggtatcatagagtgttttctgtagttattattctataactatttatttatgttttataagtcctatgaaatatcacttaaaggaaaattctctcagccttgttcccaaattctgtgtgatcacaaagacactattgctttctaggccttgctttcatggaactgaacctaaatagtgtaccttttttaggtatctccagggtctttctttaactatttttgctcaagtaaaagtgaatagcaaaaatggagtattttaaacctgaaaaaaaaaaaaaaacagaaaggaagtgaggtggcttgacttcctcctaagtttatagtaagtatattttctcatgggaagaaaaaaacacactgatgattagaaacactttgctttttgttcagccacaacctagctatttcccacaaaattaatccactgttaccagaatagggaagcatctgtacacatagagagaaatggaacctaaatatttctggaaacctcaagtcacttacacattccacaagttgcctcatatcgagaaacacagaatttgttcaaacatttcaatacttcaccagattgagtttgcaaacaaaaacattttggaattgtggcaaagggagtggctgtcatggcagaggtgagctcagacatgtggattagtattcagacgataatttggctccagaaatcatcaccacggggcacacaaccctgtagtcagaaaggacctcatgaatcaccccatagattaccctaaaatttaaagattttctccagaatgaacctagtaaagaagactattctaagaggcagcttatctcattctgaaaacatctttgttgtttctttctttcttttctttttttttttttttttttttgagatggagtctagctctgtcccccaggctggagtgcagtggcgcaatctcggctcactgcaagctctgcctcctgggttcacgccattctcctgcctcagcatcccgagtagctgggactacaggcgcccgccaccacgactggttaattttttgtagttttagcagagacggggtttcaccgtgttagccaggatggtcttgatctcctgaccttgtgatcctcctgccttggcctcccaaagtgccgggattacaggcatcagccactgcgcctggcctgtttatctttatttctttttttttttcttttattattatactttaagttttagggtacatgtgcacattgtgcaggttatttacatatgtatacatgtgccatgctggtgcgctgcacccactaacttatcatctagcattaggtatatctcccaatgctatccctcccccctcctcccaccccacaacagtccccagagtgtgatgttccccttcctgtgtccatgtgatctcattgttcaattcccacctgtaagtgagaatatgcggtgtttggttttttgttcttgcgatagtttactgagaatgatgatttccagtttcatccatgtccctgcaaaggacatgaactcatcattttttatggctgcatagtattccatggtgtatatgtgccacattttcttaatccagtctatcattgttggacatttggcttggttccaagtctttgctattgtgaataatgccgcaataaacatacgtgtgcatgtgtctttatagcagcatgatttatagtcctttgggtatatacccagtaatgggatggctgggtcaaatggtatttctagttctagatctctgaggaatcgccacactgacttccacaatggttgaactggtttacagtcccaccaacagtgtaaaagtgttcctatttctccacatcctctccagcacctgttgtttcctgactttttaatgattgccattttaactggtgtgagatggtatctcattgtggttttgatttgcatttctctgatggccagtgatgatgagcattttttcatgtgttttttggctgcataaatgtcttcttttgagaactgtctgttcatgtcctttgcccactttttgatggggttgtttgtttttttcttgtaaatttgtttgagttcattgtagattctggatattagccctttgtcagatgagtagcttgcgaaaattttctctcattttgtaggttgcctgttcactctaatggtagtttgttttgctgtgcagaagctctttagtttaattagatcccatttgtcaattttggcttttgttgccattgcttttggtgttttagacatgaagtccttgcccatgcctatgtcctgaatggtaatgcctaggttttcttctagggcttttatggttttaggtctaacatttaagtctttaatccatcttgaattgatttttgtataaggtgtaaggaagggatccagtttcagctttctacatatggctagccagttttcccagcaccattcattaaatagggaatcctttccccattgcttgtttttctcaggtttgtcaaagatcagatagttttagatatgcggcgttatttctgagggctctgttctgttccattgatctatatctctgttttggtaccagtaccatgctgttttggttactgtagccttgtagtatagtttgaagtcaggtagcgtgacgcctccagctttgttcttttggcttaggattgacttggtgatgcaggctcttttttggttccatatgaactttaaagtagttttttccaattctgtgaagaaagtcattgatagcctgatggggatggcattgaatctgtaaattaccttgggtagtatggccattttcacgatattgattcttcctacccataagcatggaatgttcttccatttgtttgtatcctcttttatttccttgagcagtggtttgtagttctccttgaagaggtccttcacatcccttgtaaggtggattcctaggtattttattctctttgaagcaattgtgaatgggagttcactcatgatttggctctctgtttgtctgttgttgctgtataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttctttctttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtctgccagtattttattgaggatttttgcatcaatgttcatcaaggatattggtctaaaattctcttttttggttgtgtctctgcctggctttggtatcagaatgacgctggcctcataaaatgagttagggaggattccctctttttctattgattggaatagtttcagaaggaatggtaccagttcctccttgtacttctggtagaattcgcctgtgaatccatctcgttctggactctttttggttggtaagctattgattattgccacaatttcagctcctgttattgtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgagatcccctttatcattttttattgcatctatttgattcttctctctttttttctttattagtcttgctagcggtctatcaattttgttgatcttttcaaaaaactagctcctggattcattaattctttgaagggttttttatgtctctatttccttcagttctgctctgattttagttatttcttgccttctgctagcttttgaatgtgtttgctcttgcttttctagttcttttaattgcgatgttagggtgtcaattttggatctttcctgctttctcttgtgggcatttagtgctataaatttccctgtacacactgctttgaatgcgtcgcagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagacagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttgaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtgttgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagattttcctccatccttttattttgagcctatgtgtgtctctgcacgtgagatgggtttgctgaatacagcacactgatggatcttgactctttatccaatttgccagtctgcgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccggttgttcctttccatatttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgagaattatgtgtcttggagttgctcttctcgaggaatatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcgtcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcctgtagctcagagtaatttgatcgtctgaagccttcttctctcagctcgtcaaagtcattctccgtccagctttgttccattgctggtgaggaactgcgttcctttggaggaggagaggcgctctgctttttagagtttccagtttttctgttctgttttttccccatctttgtggttttatctacttttggtctttgacaatagcgatgtacagatgggtttttggtgtggatgtcctttctgtttgttagttttccttctaacaaacaggaccctcagctgcaggtctgttggagtaccctgcagtgtgaggtgtcagtgtgcccctgctggggggtgcctcccagttaggctgctcgggggtcaggggtcagggacgcacttgaggaggcagtctgcccgttcttagatctccagctgcgtgctgggagaacgactgctctcttcaaagctgtcagacagggacatttaagtctgcagaggttactgctgtctttttgtttgtctgtgccctgcccccagaggtgtagcctacagaggcaggcaggcaggcctccttgagctgtggtgggctccacccagttcgagcttcccagctgctttgtttacctaatcaagccttggcaatggcaggcgcccctcccccagcctcgctgccgccttgcagtttgatctcagactgctgtgctagcaatcagcgagactccgtggtcgtaggaccctccgagccaggtgcaggatataatctcctggtgcgccgttttttaagcccgtaggaaaagcgcagtattcgggtgggagtggcctgattttccaggtgctgtccgtcacccctttctttgactaggaaagggaactccctgaccccttgcgcttcccgagtgaggcagtgcctcgccctgcttcggctggcgcacggtgcacgcacccactgacctgcgcccactgtctggcactccctagtgagatgaacctggtacctcagatggaaatgcagaaatcacctgtcttctgcgttgctcacgctgggagctgtagaccggagctgttcctattcggccatcttggctcctctctctatctttatttcttataacttgttttaatcatcctgtttgggactcgtagctctgacatttggtgatattaagaacacagggattacttattcacaggctgtgatatcacatagtggaaaacctttattatttatgactcctgggataaatattccaggtttctacacacaagatgattttcatgttttctgccatctgtattataccctctttgtcaatatcatccttaaaatgagctgccctgctcccagcaaaatgactcatctagcaatgcttatatgagattcctgaatgcattactatgacagggtcacatctcaatttcatttttctctttataaaaggaatttataatctttcccagattataaattgtcaattaacagaactaataaaaattattttaaaagtatgtatataagtaactgctacaagcattttcaacaatgatgaacatgagaaaagctatcctattctctggagttaaatatttattttgaaatattaagatatttctaatttttcaaatccattgataatatatcattatctgatgggaaaattttcaatagatataaatgtatttagaatgtaaaaatgaattcagaatggaataataattctacttatagtagtattcacagagaaagtagaactattgccaccttttaattgggtggtagatttcaattgttctcactgttttggcagccttgtcacaggattccttatgtgaggttttatttgcctaaatctcattccttcctcacatgagtcatcaccaagccaggaatcttttgtaccttgcaagcgactttctggaatacaggctatcaaactttttcctaataaattttatttcatttttctgtagctcctcattcttatctgtcaatgtcattttacaagtcttgaagctgtcttctacagcagagctgcaaatctgtttccacttgagcttctgataaacatactaaacaatatatgctgatgacccaacattcagaatcacctttcaatttgacacagacctggtagtaatactctttagagatctagtttaggatctctaaacccaggaaatcacttgggttgatctctaaacccaggcaaattctctttacccaggaaattcactaatctatcaagatacagacacagtgtcaagtactcggctgaagtagagatacataccacactctgttctaaagggcaataacagttttttttccccattagaacggacttactcctggtaaacctggagctgtaaagctgatacgtaggaatcattcaacaaagtgtacgcattagtattattgttatcagtttgtattaatcaatacactatcctctaaatgctcccaaattcattgtttaaaaactagataaggggttgggttaagataataagtccttattttctggaacgaggaaactagttaaggttaacttcagtttggtcatctggtaccacagaaaaatctaacaccacagagacactgggtcatatgcagagatttattcttaatatttcctaactgaaaaacagctcattaggcacatctggagaccttggagctgtcctaggtacaagggtggggtggcagagaaaagcttaatgtagactctctactctcaaacgactcattctggtgaatagacactagttaactatgcaggtaaagttttcttcattcttgtatctcaacatctgacacagaccctggcttggtaacgggaactcacatgtgtgtgatgaaggtaaggagcactccgaagagagcctggtgatgcagaactagcaggcatgtggtgcatcccaattcccctagtgcttcaaagtccttacaaagcagaaccgtggccccgatgtgaggcacacaggctggggacacaattccttttcaaagagaagcaactgaatgctcagaagtagagtgacttgtgaagggtcactgggaagaacgtggcaaagctgaaatgaacactcagatctgcagactataagtcatttgcagggccaggcatggtggctcatgtctattatcccagtgctttgggaggccaaagcaggaggatctcttgtggccaggagtttgagactggcctgggaaacatagcaagacctgtctctacaaaaaatataatagaaaattcaccaggcattgtgctgtgtgcctatagtcctagccactgaggaagctcaggctggaggattgcttgagcccagaagtttgaggctgaactgagctatgatcatggcactgcactccagcctgggtgacagagtgaaatcccacctctaaaaagaggggaaaaaatagctttttttttttttttttcctgagatggagttttgctctgtcgcccaggctggagtgcaacggcacgatcttggctcactgaaacttttgcctcccgggttcaaggaattctcctgcctcagcctttcgagtagctgagattacaggcacccaccagcacaccaggttaattttttttttttgatagagacggggtttcaccatgttgttcaggctggtcttgaactcctgacctcaggtcatccgcctgccttggcctcccaaagtgctgggattacaggagtgagccactgcacctggctggaaaaaatagtcttaactatagtcccagctacttgggaggcagaggtggtaggatcgcttgagcccgggaggtcgaggatgaagtgagctgagatcgcaccactgcactccagcctgggaggcaaagtgaaaacctatttaaaaaaaaaagtggtgacttcaaatcactctctttcagcattagagtaaggtaggaagtctgcatatttttagattctcatgatttttctcatggaaggggtgatcatttctgatcactgccattgcatcatgacaacaaagctgcttctgtgtgtcctagaatacaaaatgcaaatggaatccagcctggtaaaaatgtggaaggagagcaagaagccctttggtgagcatagccaggccacccatttaggttgtgttggtgcacatccttgcaggccccatgcacatcacaacttccacagactcacatgtgctttacaacagttctctagaagatggtagtaggagatcttattctaacaaaacagtgtaatatgacagcatcccaagagatagaagtaacatgtcttgagaaagaagtgcctcttttctaatcttcatggagacagctcatggactgtgattgctttgcatccagtctctccagatgacctattgctctcaaatatcactaatgactgactacaagccaacaagagagagggttgagtttcatgtatcttgtgcagagtaggtgctgagttaatatttctcgaattcagagttgtgctaggtctcccaagaatttcataatgtaatgctgaagagcatgggctttggggtcaggcaagctaaggttcaaactttgactactgcttaggatactagaataagttctacatcttcattgtcctcatggaaagattcatggtcctcacgggtaaaatgtgatgaataaaatctgcaggactgggaggagtaaaggatataaataatattgcattccatgcctggtacgtagttggtgctgtcgacagtagctagagagagagaaatgaatgatggtaaagagtgcaggctactctacctgtacccatgttcatcatagcactatccacaacagccagaatatggaatcaacctccgtgtccatcgacaggtgaagaaaatgtgttataaatacacggttgagtactattcagccttaagaaacaaggaaatcctgtcatttgcaacaccatagatgaacctggaggacattatgctaagcgaaataagctgggtgccaaaagacagctactttatgatctcacttatatacagaggctaaaaatgtcaaactcacagaggcagagagtgggatggtgcttaccagaggctggggcaggggaaggactgagaagaggttggccagggatacacaatttcagttaggaggagaaacttcaagaaatctgttgcacagcatggtgaccacagctaaacacagtgtcttgtattcttgagcacttctaagagagtagttttaagtgttcttaccacaaataactggcaagtaggtgaggcaatgcatatgttacttagttcagtttagccattccatagtgtacgcatactgtatatcaaaacactatgttcttcttaggacaggcgatgaggacaaaaaaagaaaaaacattatgtcatataccataaatatatacagttcgtgtccgtcaattaaaaaaaaaattatggctgggtgcagtggctcacgcctgtaatcccagcacttcaggaggccgagatgggcgaatcacctgaggttgcgagtttgagaccagcctgaccaacatggagaaaccccgtctctactaaaaatacaaaattagccgggcgtggtggtgcacaactataatcccagctacttgggaggctgaggcaggagaatcacttgaacctgggaggcggaggtggggtgagccgagatcgcactattgcactccagcctgggcgacagagcgagactccttctcaataaataaataaataaataagtaaaaatttacaaacagagcacagactgtggagtccagctgcctggagtcaaggccaagcttgtctctacttagctgtgtggcatttacacaggtccctgaagctctccatgccgcattttctcttctgtaaaagtcttttggggaggtaaatgacagaacacatgtatgggggtcgttgctgctggcacctaatatttctgatccttaggcacagcctgctccccttcaaatcaggcctggccttgggattgtgctttggcttgtggtatctgtttgttcacttctggctggagcttcaggagacagcgtgtgatttgatatttctctttatctgccaggtagtgcaaaatgacatacagcacagcctggccagtccaaaactgacacatagtaccataaaatcttctgggactttgtcggtttaggtcccagaaaatattgatgatattttattattgcaatatggcctcccccatctttttttttttgtgacagagtctcactctgtcacccaggctagagtgcagtggcgtgatcttggctcactgcaagctccacctcccgggttcaagtgattctcccgctttagactccagagtagctgggattacaggagcacactgccacacctggctaattttttagtgtttttattagagatggggtttcaccatgttggccagactggtctcgaactcctgacctcaggcaatccacctgcctcggcctcccaaagtgctgggattacagaagtgagccagcacgcccggccagcctcccccatcttaaggaaaacagaatctaaagtgcccaaactcgtgtctggcccatagttggtactcagcaaatgtttattattgttataataataatgattattcctgtcatcattcctaatgatgttcatatttgaacagccccagctctgcctagctacaccttggccattgttggacttcatgattttaagatctctcttctctagaagaaacagtttagtatttggcacaagagaaacacagaaaactacttcaaacatctattgactgactgtggatgcatctgaaagtgattcatctctgagtctttatttcattatctgtacaatggagatgaatcctaatgactgagaagtttggtcacaagcaaacttcttttggctgcagtgcctgggacaaggtcagcactagccactcctgtccgtgctatctcctttgcagcaccaatcccagctcctccagccttcacatcctagtctctcaccagctataagacttttctttctcctaattgttggctgttccacagggagatggagaggagcttgctcacttgttaattttgctattgatagcttgaggaaaaaattacatctagtaggagactctaatcagaatatctgtggaatttaggtagctccatcatttctagtccacaaatgtagctatgaaacattggaatcctttatggttttagaacgacctaatgcatttggtgtctgtggctatgtgtagctcaacaatgttgtagcctgtactcacacttagctataccaggtgatcattttcccactgtcttggcttttctgggaagacctgctcaatgctgctacgggcacacgcaggtggacaggtcacgacctaggagtcactgctctcagccaaatgtcacatgtaattgtgtcccaacatcctcctgaaaggagcctttcaaataactgaaaaaaactaattaaatacgtatagcatgaatcatttctggaagataactaaacccaagcagttacgccagttggtcttcatcatagttccttaatttaatagtaatcttcataggaaattgtggtatcacgtgaggtggatctggcaagctttttcatccggttccagatggggaacttaattgatctcaaatttgctcactgagctttaaagtgtggaaaaagacccagagccctgactttccagccaagtctcaggtccccaccactgggccacatacccttcccaggggccagcagaggaaatagaactcaatttgtgttaaaggtttacaaacctgttaatgctttttgttcagtatttcaaaatttagagaacatggtgctgcacattttaaggaatattacttttcttccttccctcctgcatcctgttttctctcggtgctattatggttcacattggttggcaatacattgcagcaagaaaggtattaaaagcttgaggtggtaaaactataaagttaccagctttccatgctaattcgtgtgaaaacatgatgcgctccacatctttcatggtgcaataacataggtgagtcaacatcaggcacgtgagtttgttcaagcaagtcatttgaagtcagaatggtaacttgtggaggcggatctgtgacatgctgggaagaagtcaggtttagtataccatattgcagtttattatccatgaagtagattacccaaaaaacttagccattttgcagtatgtataaaacgtgcctttattcagcaattcagtttctaagaattccttctaaataaataaggatgtgtacagatatatagatgtaaagatggttattgtaatttctttaggataatcaaatcatggtacatctgaactgaatcatcctgcattcattaaaacagcagtgctgggatttcatcatttatataaatatggaaaattcatttaagtactaagcaggttgcagagcagcaaagatgtcattatttttacttttgagcaagtgaagatggagagacagacccacagtcagaagcacatatttccaggtatccgtaattttgtaattttcattttccttttacctatatttcataattattctgtatgtaacgtgggttatttgcatcatcaaaatgcctttcaaaataatgtgtaaaaacagtattaattgcctttttaaaaaattattattatactttaagttttagggtacatgtgcacaatgtgcaggttagttacatatgtatacatgtgccatgctggtgtgctgcacccattaactcgtcatttagcattaggtatatctcctaatgctatccctcccccctcccccgaccccacaacagtccccagagtgtgatgttccccttcctgtgtccatgtgttctcattgttcaattcccatctatgagtgagaacatgtggtgtttgtttttttgtccttgcgatagtttactgagaatgatgatttccaatttcatccatgtccctacaaaggacaagaacttatcattttttatggctgcatagtattccatggtgtatatgtgccacattttcttaatccagtctatcattgttggacatttgggttggttccaagtctttgctattgtgaataaaaaatatggaacgcttcacgaatttgcgtgtcatccttgctcaggggccatgctaatcttctctgtatcgttccaattttagtatatgtgctgccgaagcgagcactaattgccttttttttcttggactgagtttgctaacatctgtgacataaggttaaagatgcaccatttagtgtcattttgcccccaactcactctgtgacaacttttggtgccatgaatttccagagggtgggatgcacgtcttgctaactgcagcatcaccccaacagagcagctcatggttattggcctgaaatgggaattttgattaggaactaaggaaagggcatctcatttcctagctgtgagcttctggacagtggggctgtgtcttttgtcatctttgggctcctgttctcctttccactgaaacatgggccagtggctacctggtagcagtcactcagaagtgtgatccagatctcattgtgggtggggagatcgaggcacataaagatgaagtggcctgtccccaggcgcatagcacctgcccctgctccactcacagatactgggcgttctgtgctaacaggggcaccttctgggcaagaggatgaggggagcactgaacacctctctcaagagaaattttttttcttctgtcacacatgcatacaaacaacaaccgatgagcttgtggtttgtcttcaaggttcaggaagactcaacttttccagcagaaaggacaatgatgcctcaacagagccggatgactctcgatggccatgccacttaacaaagcgtggccacccacttgttcacctgcagcctgaggaaaggaacagctgcaacacctgccagggacttaggggatgaagccctggaggctgatcagatatcctcctctggaggtggagccacatggctaatacgccactggacacagatgtgtgcagttttgtgtttgctgtgggctgtgatgcaaatcgcattttgtagtccccatctttggagatgctccagacagtccctcggagaaagacagaaatggatccctttgttctttctgttctttccaggcaacctgcctctgaggggaagagggcccagacataggatgctggtaagcaactactgtaattgtcagcgtaaggggctggaactcaggttccatcctgcacacttgcacaagcccaccaatgggatcaaagatgaagggtggcagcgattggagaggtcaggataagaagattcaagatgccagaaatctgcaacatgagatacagcccaggctctgggctcgttcctccagggctgcgtcgctgcgtagctgatgtggcctgtgagctgggcctcaaaggacattgcatttaaagcagaggagaggaggaaatttttgggagataagatgggatttacagagacaccaaaagagcaaaagaaaataattcctgatggtctgagcacatagagagtcaccgtggaggagactggacattggtacatatcctacaatgcctgccccatggctctggcctcatgccatgccatgcaacatggcacctggcatctcagtcaacagatgtcccagatctcagtcgttggcatttattaccaaattattctgccatcttatattcaagtccttccaaagcctttcttgttgtgggagggggagaatcttattttttaaattttattttagttattttatgtatataagttgtacatcatgatggattttttaaatacatttaattgtgtatgtttaaggtaagcatcatgatgtttatatatatatatgtgtatatatatatgtatgtatatatatatatatatatatatatatatagtaaattggttaatatagtgaagcaaattaatgtacccatgttttgtgtgtggggctgaagtatctacaatcaactcatttagcaaaaatcctgaatacaagacactgttagtattggcggtcctcatgttttacattagatctctagacttgtccgccctctttatctgcgactttgtaacccttgacctacttctctgcaattccttcctgccacactgcccctggtaaccacggtgtaattctctatttctgtatatttgaatttgtttaaaagattttacatatgagtgagattatgcaatatttttccttctgcatctgacatatttacttagcataatgtcttgcaattccatccatgttgtggcaaatggcaggatctccttttttgaggctgaaggatattcctttgtacatatatatcacagtttctttacccatttgcctgccaatgaacatttaggttgtttcttatcttagatattgagaataatgctggaatggacatgacagtgaagatatctccctgagtgctgatttcctttcctttggatgcatacccagaggaggaattgctacatcttgtggtacttctaactttaatttctttaggaagctccacttgctggtgtcaggtgataatgcataatggttttgatttgcatttccctgaggattagtgacattgagcatcttttcattaacctgtgggtcattttgatgtcttctttggataaataactattcagataatttgcccattttttaattgggttatatgttttttgctattgagctgtgtgaacattttataaattttggatattaaaccttatcaaatatatgtcttgcaattatttttccaatctataggttactttttcattttgttgattgttttctttgctgtgcagaagcttttcagtttgacatattcccatttatttatttttgcttttgtagccttttggtgtgatattcaaaaattattgccaagggcaatgtcaaggacctgttctcctatgttttctccttggagttttatggtttcagattttacatttaggtcttgtatccattttgagttgatttttgtgtatggtacaagggcccagttttattcttttgcgcatgcaaatccagtttccccagcatcatttattgaagagattatccttttcccattttgtcttcttggtgcctttgtcaaaaattagtttactgtatatatatatatagatttattttggggctctctcttttgttccactggtctgtggtctgattttatgccagtatcatagtgttttgattgttatagctttgcaatctaatttaactcaggaagtgtgataactccaatgtcattttctcttctcaaaattacttttattatttagtttttttatggttccatacaaatttcaggattttttaaatttctgtgaagaatgccatcgggattttgataaggatgccattgaatctgcatattcctttgggtaatatggacattttaacaacatcaagttttcagatccatgaatatgggttatctttccacgtatttgtgtcttctattaattttatcaatggtttataattttcagtgtacatgtcttttacttccatggttaaacttattcctaactgtatttttgatgctttcataaatacaatcgtttccttgatttctttttcacgtaggttgttatttgtgcacataaatgcaactgattttgtatcctttaactttaccaagtttgttttttagttctaacattttttttttttggtggagtctttggggtttactaaatatgggatcatgccatccatagagataatctgagttttttctttctgatttaaatgccttttatttctttttcttgtctaattgctcttgctagtatttccagtaccacgctgaatagaagcagcaagagtgggcatccttgccttgtaccagatcttagcggaaaagctttaatttttttcccattgactatgatgttaactgtggctttttcatagccttttttatgatgacaaactttccatttatacctaaactgttgagagtttaaatcaagaaacaatgttgaacttcgttgaatgctttttctgcatcaattgagatgatcatgtgatttttatctttcagtctgttaatgtatcacattgattaattagtatatgttaaatgagggtccatgtcagtgataaatttcacttgatcatgatgtataatattgtgatgtgttgttgaatttggtttgctaatattttattgtgtttttttcatcaatattttcagcgatattggcctgtagttttcttttcttacagtatctgtctggcttaggtatcagggtgatcctgcactcatagaatgtgttaggaagtattccctctaggtgtattttttggaagaatttaggaaatgttggtattaatttgtcattgaatgtttgaaggaatttagttgcaaaaccatttgattctgggctttttgttgttgtcgtacttgttatgaaatttttaattactactctgatctttttatttgttattggtctgtgtaggctttttatttcttcctaattcaattttggtaggttaaatttttcttggagtttgtctgtttcccttagggtatccaatttgttggcataatattgttcacaatagtcctttatgatcctttttatttctgaggcatctgttgtaatgtccttccttttatttctggttttatttatttgaggcttttctctttttttttttttaagtttacctcagggtctgtcgattttgtttgtttgtttttaaactaactcttagttttattgatttcttctatggttttttattctattttgatttatttctgttctgatatttgttattcccttccttcttgtaactttgggcttgctttgttcattttttagctccttgaggtgtaatgttaggctatttatttggggccatcttctcttttaatgtaggtatttattgatcagtactcttaagaatcttaactttggtggtgcatacatgaacttaacatgggtggtaaatttatctagaactaaacgcgcctaaatacatacacagacacacagataagtataagtaacactggagaaatctgaacaaaatcagtgaattgtatccatgtcaatattctggtgtgatatactaaaatggttattgctgggggaaggtgagttaaatatacctaggatttccctgtattattgtttgcaactgcatataaatcaacagttatctcaataataagttcaattaaaaaaccaaaattttatgcatatatcaatatgacatgcttaaaagaagacttgtaaatttgcctttgcagaaggagggaaaggtcgtgagtgattcccacttctcttggaaaggcccatagttagcccatattctctgagcccacatgcagtgtgctattcacatcccaataatgccgattgataaatgacacacagtttttatactttttactcgagacttttacaaggataagcttagctgaattgtacaataacattgtaaattaagctatttgaactttattttacaagaaagcaaaagtgttgcaaaatgccttgctaaatgcccacagatggtgaatgataaggagttaaacatagctgtttgctccaagtccagagctctaagctgcttgtactgtctcagccccattctttttttttttttttttttgagacagagtcttgctctgtcacccaggctggagtacagtggtgcaatcttggctcactgcaacctccatctcccgggttcgaaaaattctcctgtctcagcctcctgagtagctgggattacaggcatgtccaccatgcctggctaatttttgtatttttagtagagagagggtttcaccatgttgggcaggctggtctcaaactcctgacctcatgatctgtcctccttggcctcacaaagtgctgggccacacccagcccagccccattcttaacaagagatcctattgcccagattcaaaggctctgtgggaaacaaggataccatttacagtactggtgaaaatacagaacgtttctctttcttaagccttgtatagtcaccacccccacattcatgcctgccgccagccttggttgttgataatgccatgaacactaggctcaggccatagagctgtgcgggctctaagcaatgcccactcctgagatggggcttatcagctgcagagacctccttgtccgggtttggaaaattccaagggtcagagtgcaactgaactttttcttttgcaatttgcacctgtgggtcctagtgctacctctggagttagcacttctttcgtatgccagttctcccagggtctgctggcagtgtgctggaagtggctggtgctgcggggcagctgtgggcagaggaccaggggagccactcctcctggtacactgggagatggaggtgacagcctgagctatatgggttcccttagcagctgacacattctcatctcaacccaacaaggatgaaagatctacctttggggaaaggtgatggaatcatagcaatgatgttctaggaatccagtttcttcatatttgagaaaatgacttacatgtgcaaaaatgtctatgctggaaataatacagctttatacaatatagcactctgatttgaagaaccttgccctgcattctcttgtgtgaacctgcccacagccatgtgacacgagccaggcagcactcttgcatttagaacttggcagagataaaaatgaggctccacacctaatgctttccttcagtactggattcagccgcttcacttatttttttctgccaaaacaccactgtattttcagcctcccaggtacggggacgaatttaaggctgcctgcccagtagacagtttagtgtggggtaaatagcaccattctagcttcatggcttccccgagcccatcctgctctgcccccggctggccgcctgtcgttccagcctcgccctgtttccctccgtcccctctttagcacttgttctcttggtcctcatctttcttccaggagggcatgtcctgggtccctgtgcctaggatctgtttccctttcctgcactgccctttctcctggctcttcttttccgtcgccctccccctcctaccagcttgctccttgccttagacacagacattgacaggtccagcgaagagcgcctttgctgcagcccagtgtgtccagatcttcccgcacctgtgccgcctggcgctgctgaggcagggactcccgtctccccaggagctacctggaggaggctcagaatccatcctaaggagtttgatgacatatgtgccagatcgtgtagaggtgtccaggtatgccccaccatgtggaccgtaacacagacacgcgggatggatggacgcgtccccccttggaagtgtccagagagtgccaagggcaggctctccatcctcgctgggagcatagccagcgccacacacagaggccaggtctcagctcagcctgggagcgcccggttctttttactgctctgtctgcctccctttctgagtgtaacagttcctctccttccttcttcacctcttccaatctgtcccaaacaccagcttccccagggattcacgtcccaaatccttaaccaccacatgggacaagcatcaaccccgacacgaatcaagcagaatccgtaccaaccaggaccccagaggtcccttcaggacctcagggagtagggctgggtcgggggtgtcttgaggaaagccagggtgacccgaggccctgggggaatctcagtcttgtaaaaaagcggcttggccacagctgtggttaccactcatctctcatgagcgctctcatcatgcctccctactttcctccttccgcgagtctgcaggaagggttttctaggcccctttgcccatttcccatccactcggcctcagcacagcccgtagcggccaccagagggcgcccctctcctgcagctccgcatccccgcacagctgaagtccagccaagccctggccttggaagacccttctgctttctaacctgacagaggcgcgtggaggtgggggggccctcagagctgcagaatggacaaaaactcaaaaagggtgtgaatttcgccatgaggtccgggttcctggggcttcgctgttgttctgtttattttacccgaaccctcctataccatctgtatgagaaaatattctcaaatattgaatcatgtaggactttttttttcttttaaaggatttgatatgttaatgggttaatttgggcagagatacctccatctccaatccccttctgtcaataacagctctagttaccatgagaacttttgggcttttcttaaacagcccattctcctgttcaatctttttggtaatcaaaatagcctccaaagggcattcttttaaaatcccataagatccttcatcacttttgtcaccatagaaataataaacacataaataaccctccaaaggcaaaaaatttatcaaaaatgagatatcagaaatataaaaattcagtggctcttggtcagctggtgctggaagacccgtggcttacagaagagagaagggacctctgaagttctgcacagttgttgaaaagccagatgcaaaatctgtacctaagactggtgcgtgagagactcacgttcctccatttcgaatctggttaacttgctatgattgagaagctcgctcacaaatcctcaccctctcattcctatcctttctggattgagtgaaagattttcaggttgtgaaggctgaagaaaatggctgctgacttcacaacctgtttcagccaaattgcaaagccccaaagggtcagtaaaattcttgctgggcttcatcagacattacatttcataggggcacgggaggagtgtgctcttctgtctaatgaaatgtgggccttcagcctcacttccactgtgattcttgaaaaacatttatttcctcactaacggttcagtgttcagcaacctgggaggtttgccctagtactattctacaaggtcacaggtatactttgcaaggttctgcctctctttctctcggagagcttattctctcttgtggcctaaacctcacctctgtctgcacatgacactcaaatcagtttttttctgctttatgcttgtgtctccagagctgtttcaatgactgtattcggagtctctgcttgcagcgtgctctgcatgagaacaggcaccaagcctgcctataattggaagatctgcctgaatttccatagtgaaggtctacactgcctcccagcccattcattcccttcatcatttcattccagtagttttctaaagtgtggccactatgttgttgattatggcaacccagcatccacacaggacaacagggggcccagggccagtcctggctgctgcttatattttggccccagggatccatctgattttgtcattgaagtgctggcacatccatccccactgatgtttgtcaaatgatttcccagctcagattggaatctcaaaggtaattttcacaaaattggaaacagctcctctgatatgtccctgaaaacagtttttgttgcccatatggaggatgtgacaggacatcactaggaagatggacagactcagcctgcaacatcccctttccactgccaaagttgttagcaatccagacagactgtcaccttgaggctcaaagatcatcttacccccaaacactctgacgacctctctccctgtgtgccttgatgcaggtactgagtcttgcagcagagcagtgccaggccctgtgctgaggcctgcctgccagcaggattcgctccttccagtaacaggcactgattgagtcctccctgtatcacaggcatcggggaggagtggcaggtccagctgtctatgagccagacaccgtctctctgtcttcagcccagctggatatggagaacattcaacaaataattgcacatgtagttaataattacatttgtgataaataccagcaaggagaaggatgtgttgtcatagaatatgcaacaagatggtctctgggactggatgggggtggagaatcaagaagtgtatcttgatggatgggctcagaggggcttgcagaagagggacaccagtgttcagggtcatttggtggcaacgcaggattggctggagctgcggtgctcgtgttcaccttgccagctaccatttcacatcctgcagaggaggcaggaggcagccgtggagatggtttttcacaagacagcaaggagattaagatggtggagaggaggactagcttaatgctcccacttggacggacagagcagtgtgtggagactcacattgtgaacttctgctccaagaagtaccacaggaatctaccaagaaagtcaagagaatccacagaccctttgaaggaactggatccctgctacaggctccctgagatgccaaaaaactatgagtctgcttattttctcagtggggaggctggtggtctggggcaagttctcagccctggtcaccagctgcctggaagtagactcagtgctgttgccggggcacagtggaagtaatactggcctctaggactgccggctgcatgggagtggggtgaggcctatgattgccggttttcccccacttccctggcaacctgtgtaatgcagcagagacagccataatctccctggaaatataactccattggcctgggggccacacccccacagcagccacagcaagccctgccccaggaaagtctgagctcagacatgcctatccctgtccccacctggtagtctttctctaccctccctggtagctgaagaaaaaggccatagtctcttgggagctctgtggccctgcccaacacctgagaaacctgaatgcttaaccaggtgaccctaggccaagtttgcatcctccctcatgcacctcatgcacctcatgcactcttgaaagcaccacctcctggctggaggccaaccaacacaaaatcagcacaaagccagcacactaaacaaaaatacaactaaggaccctcacagagtccacgtcactcccctgttgcctccaccagagcaggtgttggtatccacagctgaagacctgaagacagatcacatcataggactctttgcagacactctccagtaccagcctgagcctggtagctctgctgagtggcaaaaaataatcacagcggtttggctctcaggaagtcccatccctacgggaaggaggagaaaaccacataaagggagcaccctgtgggaaaaaagaatctgaacagcagcccttgagtcccagatcttccctctgacatagtctacccaaatgagaaggaaccaggaaaacaattcgggtaatatgacaaaacaggcttctctaacacccccaaaaaatcacaccagtttaacagcaatggatataaaccaagatgaaatcactgaattggcagacaaagaatcagaaagttgattattaaactatcaaggagacaccagagaaaggtgaagtccaacttaaagaaatcaaaaacatgatataggacataaagggaaaaatcttcagtgaaatagatagcataaataaaaaacaatcacaacttctggaaatcaaggacacacttatagaaatgcaaaatccactggaaagtctcagcaatagaactgaacaagcagaagaaagaacttcagagctcgaagacgaggttttcgaattaaccccatccaccaaagacaaagaataaagaattttaaaaaatgaacaaagctgccaggaagtttgggactatgttaagtgtccaaacctaagaataattggtgtacccgaggaagaagagaaatctaaaagtctgtaaaatatatttgagggaataattgagaaaaactttcatggccttgctagagatctagacatccaaatacaagaagctcaaagaacacctgggcaattcatcacaaaaatatcatcacctagacgcatagtcatcaggttatcaaaagtcaagataaaggaaagaatctcaagagctgtgaggcaaaagcattaggtaacctataaaggaaaacctgtcagattaacagcagatttctcagcaaaaaccctgcaagctagaagggataggagtcctatttttagcctccttgaacaaaacaattatcagccaagaattttgtatccggcgaaactaagcttcagaaatgaagaaaagataaagtctttttcagacgaacaaatgctgagagaatctaccactaccaagctggcactacaagaactgctaaaaggagctctaaatcttgaaacacatcctcaaaatacaccaaaatagaacccccttaaagcataaatttcacaggacctgtatatcaatagcacaatgaaaaaaacaacaaagtattcaagtaacaaatagcatgatgaatagaatactaccttacttctcaatactaacgttgaatgtaaatggcctaaatgctccacttaaaagatacagaatggggccgggtgcggtggctcatgcctgtaatcccagcactttaggaggccgaggcgggcggatcatgaggtcaggagatcgagaccatcctggctaacacggtgaaaccccatctctactaaaaatacaaaaaaatagaaaaaaattagccgggcgtgttgttgggcgccctcagcctgtgagaggctgaggcaggagaacggtgtgaacccaggaggcggaggttgcactgagccgagatcatgccactgcactccagcttgggcgacagagcgagactctgtctcaaaaaaaaaaaaaaaagatacagaatgggcccagtgcagtggctcatgcctgtaatcccagcactttgggaggccaagacaggtgtatcacctgaggtcaggagttcgagaacagcctggccaacatggtgaaaacccaaatacaaaaaaattagctggtcatgtgggtgcatgcctgtaatctcagctactcaggagactgaggtgggagaattactggaacccaggatggagattacagtgagctgagatcatgccactgcaccccagcctgggtgacagagtgagacaccatctcaaaacaaacaaacaaacaaaaaggaatggcagaatggatacaaatttaccaaccaagtttctgctgtcttcaggagactcagctaacacataagcactcacataaacttaaggtaaaggggtggaaaaagatattccgtgcaaatagagaccaaaagtgagtaggagtaactatttttatatcagacaaaacaaacattaaagcaacagcagttaaaaaagacagaaggcagtttgtggggaagagggggcttagggagcacatagcactgggcagacctggtgggggcaggagggctggagagtgaggcttggaagtttcctaattccatgggccagggtcctgccagtgtttatctctacctttcaaaatctgtactatcattggagtcaaatgtacatttgcacacaaaaactaaacaaagaaatgaaaacaaaagtctgccccatgtcaaaccaacatctgggatgcctgctcaaagccagctcttgtttctgtttcttcttctgttcctctggaggatcttctatccctcgtttcttgatttagatactttctattattccttgcctcttctctctttccactccctctcaatttttcttagttatggtctgatttttacttcttttgcctttaaaactttttatgagttgtgtgagcatatttttctggttgcaccaatttgacagtctctcttgtctcccttttatctgagatgaggaaatatttttccctgtgcttcccttctgctagtttccggagctgtacctgactttcacatttatgacgttttaactcttacactcctattccttaatcccaagtctcctgggcttgctctagatgttgactgaaaactaagaagcagccttcacaatattaggaggattgtcactgcaaacaggagtgtagtgcacttggctgcagatagaaggacctgggattcccagactgatacatctaagaagcacatactaaaattcaaagtcaagtcaaatgaagtctcaaacacttttgtagcctatctaaaggtataaagcagggattcgcaaatattttctgtacagaatcaaatagcagatatttaggctttggggccatagggtgtctgtcacagccactaccctctgctgttgcagagtggaagcagccatagaaactgcaggataaaataagtgtcatgagttccaacaaaactgatttacaaaaagaggccactgccaaaccctggtccaatgcagaggatcaaaaacccctggagggcttgctgaaggcagattgctgggtgccatccacagttcctgattcagcaggtctggggtggcctaaggatgtgtatttctaacaagtttccaggaggtgtccatgctgctagcccatggcatgtgcttgttgcttggcactaaagcatgactctcttctacatatttgtgagtttcctagaattcccaacattttccctttgttttaaacttgtcctctgacttatcaccaagattttccaccatcgtgatgcttttgctttcacaagtctgctttcttcttaaacgtttctccctagcaacatttgcacctgcactcccctgaccttgcactgtggtagaccagttgctctctaagtctgctgctcagttgtcatctgagatagtcctttattgtcttgaggatggggctatgtctccttttgtctaggatttttattggttttactgcagaatatcatcaaggatttatctttttcactgaagatgcataaagggtaaacattctgaggcctaggatgactgaaaatgtgtttatttggcatcgacactcagtataatttttttttaccaggtgtagaattctaagttgaaaataatttcctctgtggactttgaagttactgcctcattgtattccagtgttactaatgagaaatctgatgcgagtttgactgtgatttctttacagatgccctgttttgttccttgtcttctaaaacatcacaatgatgcatttaggggtgggtgatttttttatatctcctgatcaaccgtcggtgactttttaagtcgagatgcacgcagcacctcctcatagctctggaaaatgttctcctaataggctattctttgatcatttcatttttatcagtttctgtattttctctttatgtaactctttggacttcctggatttaaatgctcttattaaactttttttctcatatctctcttcatgttttctctttttatgtacatgctgacagttgtccttcaagttttctttcagacatcgtatctttattgtaatgattatatttctaatatttaagaatattttattttctgatttcctctttttcattgacatatgcccttgtttaatgggtgcaatattgtccagcttctctttaagatacaagttagaatattttaaaagtgtactacatttgatgaatttttgaatttttgccatctttctcctgagtcaattattctgtttatgcatcttggcctattatgaatagaatgtttgtgtctcccccagatccacaggtttaagccataatgcccggtgtggctatatttggaggtgggggaggggggtctataaagaactaaagttaataagatcttaagggtggggctttgatccgaagggatttgtgttcttataagaagatacaccccagtgctctctcacagcatctctctgtctcttttcatgcaagccccaaggaaagaccatgtgaagacacatggagaaggtggctgtctgcaagccaggaaaagagccctcaccaggaacatgttgagagaagcagtcacacaaacgtagtcttttgacctctgtacagttgcataggagtgtgccttgggttaggaacattttcttacaaagagataaagagctttcacagcctgcgctgtccattaccctttatggggaacctctttctctgttctggactggaggcgtacttcttcgttctactaaagcatgtgcatcatatggcacctgaacgaccccactgctgggaacaggggcctttgtctatagcatgagtgtgtggaacatctccctgtgctggctgtggggtgagacccactggccatgagggatcaacagtcgaaactgaagctgctcttgctctgtgtcttctctatgtgcataaagcgttgttccatccagtgcctgcatgagtcgtgcctgaaaatcatgtggtgggttgacgtcttgggattactgctcctggaggcaggcattgttatgctttctgttctccactgtttagtgggactctgctgctggaggtggtcacaggtgtcacttgcttgacttggacttccagcctccagaaacttaatcttgaacttgcatcctccatcactgtgagaaaaaatttctgttgtttgaagcactcaatctatgacattttgtgatgtcaacctgagcagactaagacatgacccctcttttgtatgtaattaggtttatttaatattgaatggactttgttgatcctcaggtttattcccctacccctggatgacagactgcagactgctgcccccatacaaacatgagggtagctttatttgtaagagctgacatccacatagggagccctaacactccctctgcagtccagtgacaattatgttgactgtcagtgaatgtccaagtcagtgtgtgttcaaggggcagccagctgacatttgcctgcaatgtggatgtggcagcacatcctgccagtgtggcagaggggggaccctggcctcagcatgggaatgttccctggaaggctcagtcctttcatcattcaggttatcatggcgtcatcattcgtgtaatgtactgtgaggccatgtggccctcactcatatatacctgacatgtgacacaaattcactgtttgttttattatagaatttttttcacttaatacaaagtggaaaacttatagaaagcacaagcatatttctgtgtgttctcagtgtctttgggccatagtttctgcagaatatcttggaattggttcacttggagcataatgccagagcagcattttcctaacagatatctcagggttggtgaggcacctccccttgtcagagaaagagcactggacactgttagaggcagcaagacagatttcactcagactactgcagtagggcagagaggctccagtatgaatcagtttaattccaaataagacaaaggtgactggggttttcaaagggagatctgatagggcacacaacgagattatgggaagtaaaaaaagggggaccagaaaagagactgggggctataagtaggaagctacagagtggagttgcagaggattactgaaaatggtttggccttgtgggttgggacaatttacatctggcagttcaggagcattgcattttcttgagcagagactcacacaagagctgtgtcacttttaggcacatgactagtgcaggtagaagccaggctgaagtgtggccaaggatctcagcactgcatgtgggcaagtcctttgggtcattgggaagttcacagttcacaccccaacccaaataaaacatttggaaacaaaaacatttggaaatcacgcaaggtctatcttcccactttcccacctgtggacatataggaagttttgcatgaaagaaactttgttttctgtcatgcaacatttctcaaacattcttggtatcctacacgaaatctatttatatccaacataactaatgttctgaggaacccactttatgaaacaggattttgtactgctattagtggtgagtcacaataagaagggaaagatacccaagctcgcattgtgagaggtcatacagagatgggtccaaatggaatcaggagttgagaggcatagagatgtccctagaaactggaggagaccaccaagttgttctaaagccaggagaagaatctaacattggcctgaaagctaaagcctacctgtgggtacaaattggacaaaggatactttgctggacagtcagaaattcagctgtggagcaccaggctggcagtgagctctgccctcaggcacgccacataggcagcaccaggactgaggacatctgaggctgagaacggatgtaagaaccatcttgggtgttgtaagatgaattgcatcccccccaaattcagatgttgaagttctaaccacccctttggtgcctcaaaattcagaacgtgactggatttggagctagagtgtttaaaaaggcaattaaggttaaacgaggtcatatgcctgggtcctaattcaatatgacttccgtccttaagaggagattaggatgcagtcctgcacaaagggaagaacaggcagagacaaaggaagatagcagccatctacacatcaaagagacaggcctcaggagaaagcaactctgctgacacctcgatcttagacttctagcttctagaattgcgagaaaataaacttctgtcacttaaaccactctgtctgtggtattttgttatggcagccctaataaactaatacactaggggcacagagcaggtggggaagccagatgcaatcggtcaaaagaaaaaaaaactatttagtagccaaagaagacaggtgcaaataagcaagccacggttagagtctacaacagttagcttaactctgagcctaaccctagctggccaagagacacagaccatcatgacaagggactgggggactggactttccaggaggactggaacacaggacaaagcagtgggcaggacccagctcccctatcagacagggaagaatcagagacttgtagccacagggagctcttcaaaattcatgctggagctggaaccaatctcaagatatgaattgagttgagagatgtgagatatttaagatgctgatcataaagttatcacgtctgagcctggagcagagagtaccggtgacatgaagcaatcccaattgttttagatgatttaaatctatgacaattagccttatctctgtgttcatcacaacatttggacatgaccatggcgaagaaattactgccagttgtacttaatgggctcaaattcaagctgaagttttaaaacatgaaaataagaagattttattaatatataaattgtaatgttttcaagggagagttagcatcacagtccctttgcaaaatgttgtctagggaagctcaatttaagtgtttctcattgggccaatggagacttaacagaaaacacatcttgacaatagatttggtctgttgaaatgatgacgtttgttggccaaggactgaggattcatgctgtgcactgccaagtcctatgctcttcttcaactctgctactgcctgcttttcattgtcgtcattggttcttcttccagagtacaaagaagaaaagaacatagggcaaaaagtgctatttgtgactttttagcacacataaagtaattataagtaggcatgaaagcaaggcatcccagagtttggaaagtttaataaacacactttagttaaagtgtaggtaagtgggtaagtatgcaaagttagacttaaaaaaacagaccgtgcaaaaacaagacaaaattgcattttaattgatgatattgatctacctgaagaagtaatgtgtcacttagaagaaaagagtccagcgtggattacaagaagacataatcagagatgcaagttgaaggtcatttaagaaaacatgtcagtgaagttccttccaggcctgtgcttgggggccatacacattcactgagtgaacttacatataagacctctaactaattcccattgctgtgaatctatatgcaccacaaaactttcggattctcatttgacttcccttaagtcagaataaactttcagttttgtggtagataattttattataaaataaagaattattttgcttcatatattggtttcctgtctgcttgttattgtggattttcttcagtgatggccctcagcctctactgaggcacaaacaaaaccaagttttgctatggcaaaggaggtggcgactgtgaaatgctctagtgcatgcaactcaggactgctggggaggcaccggtttggagcaggcatgcaggcatccctctgctggtaccctctcacctgacctaggcctgcaatccagaacaacgcttttgggaagaaaaactgatgtctggaactgatagggaacctgaagaatttatgtggtttattattgtgtctgtgccttgaactctttttagcaaataaaatctaattgagtttaattgaattgaacatggatacattacatagataacattttctaaggctacagctgccatagatagtgatcgctttgatgtatccaggcaaagtaaataaaaagccttttggaaaggactcaccattctagacgccacaaagaacatgtgtaattcatgggaggaggtcaaaatatcaacattaacaggagattggaagaagtgtattccaaccctaaggatgattttgaggggttcaaggcttcagtgggagaagtaactgcagttgtggtgaaaatagcaagaaaactagaattagaagtggagaattgctgcatctcttgataaacttgaatggatgaggagtttcttcttatgagttaccaaagaaagtgattagttaagatggaatctactcatggtgaagataccatgaacaccattgaaatgactacaaaggatttaaaatattacataaatttagttagtaaagaagtggcagggtttgagaggattgacttcaattctgattgaagttctacagtggataaaatgctattaaaggaaacttgcttaaggaaagagcccagggagggataacttaagccagcatttgagttgaggagacagaattgggacagagttggctcaggggaaccaacgtagctagagttcatgggacagagtacgagggaagagacaacgagagagagagaggaagaagaagaggcagagcaaaaggaagaggaagagaagagaggaagagaggaaagaagagagagacattgaactccagatatctgcaaagatgtcacttgagtctccaggttagtattgataagtgcatgtgtatgaaaatatccaagaccaaagtacagtctaatgaagtaggcataataatttccagggatcacatggaactagggatattttgtttctatcagccagaaaggcaaactgttaaaatgcatgacacattgggtacagtaatcggaaatatattggctcagtaacagaaaaaaaaaatagcccttgattaaaggtttgatctatcccacgtaagaaagattaaaagcaaagctagaaaagatcagatttgtttctaaataacttatctgcgtcctaaaacaaaactaaaaaatttttttaaatacagtaatgtattaacacatactgaaactcaatacatacagagaaacgaagataagaataagaagtccaagtgcagcggctcatacctgtaatccaagcacttggggaggccaaggcaggggatcacttgaggccacgaatttgggaccagcgtgggcaacacagcagaaccctgtctttacaaaaaaaaaaataataatttttttcctttttggtagagacagggttttactgtgttttttcggggggaagaaaaactgatgtctggaactggcagggaacctgaagagtttatgtggtttaccattgtgtctgtgccttggactctttttagcaagtaaaatctaattgggtttaattgaatgtgttcccaaataaaaggcagagattttcagattgggcagagaaagtaaaaccaacatcaaaaaattaaccttcagtcccagcttactcgggaggctaaggtgggaggatcacttgagcccagaagttcaaggttacagtgagctataattgcaccactgcactgtagcttgggtgacagagcaagaccccatctctaaaaaaagaaaaaagaaaaagaaatcagctggacatggtggctcatgcctgtaatcccaaccctttgggaagccaaggcatgcggatcacctgaggtcgggagttcaagaccagcctgaccaacatggagaaaccccgtctgtactaaaaatacaaaactaggtgggtgtggtggcgcatgcctttaatcccagctacttgggaggctgaggcaggagaatcacttgaacctgggaggcaggcagatgttgcggtgagctgagattgcgccattgcactccagcctgggcaacaaaagcgaaactccatctcaaaaaaaaaaaaaaaaaaaaaaaaagaaagaaagaaaaagaaaaacaacagtgaaatagtggaaacaataagccagaagatagtggaaaaacatctttcaagtactgaaggaaaatctggcaacctagaattctgcacccaacaaaaatagaaaaaccagaaattgactttctccataaaagcagataggaatgtgcatctacctaaatgaatgaagaacactggaaatggaaatgtgtgtgttaatatttgggtgaatacaatgacatttttatattttgaaatcactctgaaaatagatgattaaagcaaagtaaccatgtattttaattttaaaacaaattcagaagtaaaatgtgacaacaatcatgcaataatgggagaggaaaatgtaagtatacagttgtaaagctcttatacgagatttgaagtggtaatattatttgaaatcagactttcataagtcaagatgcacattataaactaagagcaaatagccatgagtgaaaaaataactaagaagataaattaaaagtatgaaaggtgctcagttgacccaagtgaaggcagaaaaatataagaaaggagaacaaagaacagatgggaaactatattaatatcaaggtatatttcaggacaagggatggtgccaagaaaaaagagggtctttcataatgattacaggagcaattcatcaaaacaatataataaccctaaatgttatgctcctaataacataacttcaaaatacatgaaggaaaaaaatctgagaattacaagaagaaacaaattcacatttatagttggagatctcaacatcccactgacaataatcagtgagaagtagatagaaaatcagtaaaaatatagccaacttaagcaacattaccataatcctgacctaatagacatttatagaatactccatcatacatattcctttcaagtgaacatgcactatttaccaaaatagactatatcataaaccatagaaaaattctcaataaaaaaggactgaaatcatccacaattcttctgacaacaattatattaaattagaaatgagtaacatgaaaatctgaaaaatcttcaaatatttgcaaataataaacatgacagcagaaatcaatgaaatagaataacaatcagaaataaaactaaaatccactttttaaaaagcagtaataaaattagttcattattatcaggaattaaaaagggacatcactacaaatcctacaactattaaaaagatgatttttaaagtattataaacacctcattacggtaagtgtggtaacttagataaagtggacatatttcttggaatatccaaattatcgaagctctgagtagctctgtatctatttttaaaattgcattcatagttaaaatattcacacaataaaaatttcagacgtacctggctccactgattatttctacattcaaggaagaaacaataacaattctcaaagtttagataaagaaaaagggatcaaatcattagtctgggttcctacctcaagaaactgaaaaaaggagagcaaaatacattcaaggtaagcaaaagaaaggaaataataaagataaaagcaggaatttataacactaaaaatataaaaacaatggaagaaaaccaataaatcaaaagcagcttttttgaaaagaaaataaaaaatgataaacatctagcaagttgacaaagatataaaagagagagacgtgtcaccagtatgaggaaggaaacaggagttattactgcagatcatgtagccattaaaagaataagggaatattatgaacaacttcacactcataaattcaacaactgagaagaaatggatcaatttctcaaaagtcacaagctatgaaactcaatcaagaagaaatagaaaatctgattagtcttacaatcattaaattaattgaatacataataaaaatctcccgcaatgagatgttcaggccccgatggttttactagagaattccaccaaacatttaggagagaattgacacaaattttatgcaatcacttccagaaaatagaagagaaggaaacactaactcatttatgaagttagtattaccctaatacaaaattaaacaaagagtacaaaaaacccccaaactatggaccaatatctcccataaacttggatgcaaaaatcctcaaaagtattagcaaatcaaatccaaatgcatagaaagaattacacgtttgaccaagtgggatatattccagagatatatatctggttcaatatctgaaaatcaattaatataataattatatcaataggctaaagaaaaatcatataatcatatagatatcctcagaaaaatatgacacaatccaacactcattcaaaagacacgcctatcacttgggaaattgcagttctgtgccaggaaccagggacaaaaaccaaatatatttcatcttgtgtatccataggttctgcatctgtggatccaacctatcatgaatcaaaaatattttaaaaaaatggagttcgtattgaacatatacagacttttatcattattgcaaataatactgtataagtataataattatttacatagtgtttacatggtactaggcaatataactaataatagagatgatttaaagtatatgggaggaggcgcataagttatatgctaatactatgccattttatatcagagacttgaacacctggggattctgattgtcagtgggaggttctggaactctgccccattgatatcgagggataactgtacatgaagttgacgcttgaacaatgtgagcatcaggagctcccctccccgacatatatgtggatttttgtgcagtcaaaaatccacatatgacttttgactccccaaagcttaactactaataccctgttgagtggaagacctactgatcacacaaacaggtgagtgaaaaaatctttgtatgttatatgtattatgtactgtattcttacaataaaataagctagagaaaagaaaatgttattaggaaaatcgtaaggaagataaaatatatttactattcattaagtggaagtgagtcatcataaaggccttcattctcattgtctccatgttgagtgagctgaggaggaagaggaagggaagggtttggtcttgctgtctcggggtggcagaagaaaatccacatataaatagatttgcacagttcaaacccatgttgttcaagggtcaattgtatgcatattttattagatacacaataagggatattatgtagctacaataatcaagacaatgtttattagcaaataatagatacacagatagatggaacaggataaagaacccaaaaataaacccacacaaataagcccaactgactaataaaggaattcatttcaacagagatgataaagcaatttaatggaggaaggatcgtctttttaacaagtgacgctggaacaatttggcattcataagccaaaaaacgaacattgtcctaaacatcacagcctacacaaaagactaactcaaagtgcatcacacacacaaatgcaaaacataaattagaaaacctttttaaaaagacaaatgaaaatcttccacgatatatggctaggcaaaaacttcttagacttggcacagaaatcatgatctagaaaggggaagaaaaaattgataataggacttcaccaaaacttttgctctgtgaaagcctatgtgaaaagaataaaaacctgggagaaaatatttataaaccacgtatctaaacaatgacttgtatctataatgtatatagaacacttaacactcaacagttaaaaatcaatccaatgagaaattagcaaaatatatttcactaagtaggacagacagatgatgaacatatgaaaagacatgcaatatcattagccgttagagaaatgcacattaaaatcccagtgaaatatcactatacacctgtcaaaatggctaaaacaaacaggcaaactaacagtgatgacaccaaatcctggcagaaatgccacataactggataactcatagatttttggtggaaatataaaatgggacaatagtatgtacagcctctctgggaaaggttcagcagaaacacttcttacaaaacacttacagtatacttattatacaacccaggaattacactcttgggcatttatcccagagaaatgaaaacttatgttcacaaaaaaccagtatgtgaatattcacagcagttttgtttataataattgaaaactggaaacagctcaaatgtccctcagtgggcaaatggtacaactgtggtacatgcatatggaacactcagaaataaaaaggaacaaactattaatatgcttaacaactttggtgaactccaggaatttgtgcccaccaaaaaaaagaaaaataaagccaatcgtaagaagttacatgtgatatgattccattaatatagcactctcgaaatgacaaaattatagagttggaagacagattaatgattgccaagggctcaagatacagggagaggctgtgactatgaaggttagtaaagaattgttgatgggtctgtttgtatcttgactgtggcggtggtcacacaaatctataagtaaggtaaaatttcatagaaataaatatccacacacagacaaatgagtgcatgtaaagcaggtgaaatttgaatagaggcaatggattgcatcaatgccagtgtcccacttttgatactgtactcttgtcatgcaatatgttaccactgagtgaaattgggggaagagtttatgggatgtgattatttcttagaactgcatgtgaatctataattatcgtaaaataaagagtaaaaaatgtataaatacctcatatactggtgcttagtctaccactaaaatttggagatgactcagaagttgtctccagaacctgaactgagcagcctagctggggtctcaggtgaaggagccctgctcaaggggctggattacccccataaactcaggcttaaggtacagcaaagccagccttggtggagaagtgtggggttgaaatattttgataattgatattttaatagaagcatttcagtagtcattatgaggggggaaagaggaaaatcagtaaataaatgtagaaggaatgaacaaaatagaaaaatcaccatagtgtaaactagtaaaataagggattcagataaggatcatcaagagatgctgaaaagcagtaaaggcagggtaataaggaacacgatattcctgcagtctcataacatcaccccatggagtgcttgcggactggaaagggtaaacataccttagataacggagcaccgttacacatttagctatgcaatacacttaacatcactaacagaaacttcctaatattatgtgcctcttggtgcaaggtggtatgaaatacacagaagccgtattcttgccaaaaatatttagtacaaatctaaacaagcttttaaatctagtttctcagttgtatgaaatatggaaaatagaagattcaaccatgaatccagaatacaaaatattccacaagctcagttccctcaataaatcaataccacgacaaaagaaaaaaggagagggctttctttattgaagagacgcaataacaaaatgtaatatgcgaatgtagactgtattcttgttttaataaaattataaaagtcatttttgaagcacttggagaaatttgaatatggactgtgtacgagatgatagtggggattagtttaattttcttcgctttgattatgggggtgtcattttatagcaggatatttccattttaaggagatatataatggacattttttagtggtgaaatgtcatattgacagtatcttccttctgaaagaaaaagtatggaagagacaaaaatagatcagaaagagcttttccccagtgtctcagagacgttttctacctggactggatgttgtgtactggatgcgctccgaatgtgacttcaaagggaacgtagttgggtgcttactaagtgccagtcttcttacacagcaggcttttagggattatctcgtttagtccgcacagcaatcctctcagttgaaatgcaatagattgtctattaagattatctgaaataagaatcttctcgggcagatgaattggttctgagagtcaggagagtgcatcaggaagtgagatcatggaaaagtggctttcttaagaagggagtgaagcttcaaacatggattcacttttggacatgtagcgaatcgaagatttggattccttaaccgagaatgcttttaagaaattgaacttcctggccgggcgccgtggctcacgcctgtaatcccagcactttgggaggccgaggcgggcagatcacgaggtcaggagatcgagaccatcctggcgaacacggtgaaaccccgtctctactgaaaaatacaacaaattagccgggcgtggtggcaggcgcctgtagtcccagctacttgggaggctgaggcaggagaatggcgtgaacccgggaggcggagcttgcagtgagccgagatggcgccactgcactccggcctgggtgaaagagcgggactccgtctcaaaaaaaaaaaaaaaaaaaaaaaaaaaagaaagaaaagaaattgaactttcttcccgaggaccaaatagattcattttgccttaacgagatgttaatactttgtgactcaagtgagtttataagtattatatgtatttctacacaaaatgcaaatttgaataataaaaatttaggaaatttttcctgtattcactttacatcccttaacttcacattcagttttgaatgagtaacaataatgtgtgcagagcctaccaaagatgcagaaagggaaagctcagaacaagcagaaataaaagctgtaacttctgaaaaaactgaattaataggctgggcgcggtggctcacgcctgtaatcccagcactttgggaggctgaggcgggcagatcacaaggtcaggagatcgagaccatcctggctaacacggtgaaaccccgtttctactaaaagtacaaaaaattagccaggcgtggtggcgggcgcctgtagtcccagctactcgggaggctaaggctggagaatggcatgaacccaggaggtggagcttgcagtgagccgagatcgggccgttgcactccagcctgggggacagagggagactctgcctcaaacaaacaaacaaataaaaacaacaacaaaaaaactgaattaatagcaagtgtatttcctgatgctgttgtagacccaaagaatactaacgaactgctccctaatagttaggcagaacttttaggcttacatagcatcaagtagtcttttctaggtatctaaacgctacaacccctaaagacatgaatggaatggagaagaacccagtagctccagacattggacacagtatacattcttctttgaatctgtgtgatattttgaactctgtgttgagctcttcacatcttgaattaaatgaggaaattaattgtgttgatatacctaatgctaaatgacgagttaatgggtgcagcacaccagcatggcacatgtatacatatgtaactaacctgcacattgtgcacatgtaccctaaaatttaaagtataataaaaaaagaaagaaaaaaatgaaagatttccaaaggattatgtgaaattttattttattgtttaaattattttattttattttattgtttaaattattttattttattgtttaaattattttattttattttattgtttaaattattttattttattttattttattttatttattttatttattttatgttatttgagactgagtctctgttgcccaggctggagtgcagtagcacgatcacacctcactgcaacctctgccttctgggttcaagcgattctccttcctcagcctcccaagtagctgggactacaggcatgcaccaccaagcccggctaatttttatatttttagtagagacagggtttcaccatgttgggcaggctggtctcgaactcctgacctcaggtgattcgtatgcctcggcctcccaaagtgctgggattacaggtatgagccactgcgccgggccagattatgtgaaattttagataaacacagaagaatttatgaatgacgatgaacaggaaatggagaaaattctaatatcatgcggtactttgtcagccagagtcagtgacaattattaggctgatatgttgactgccatgccagggatgatcaaatctcttaccatccactgtctggaggtgccaacacctgctgaactggctttccagatcaatgaattacagtcagacactgtgtaataatgtttcagtcagtgacaaaccgcgtatacgacagtgatcccatggattataacagagctgaaaaattcctatagcctcttgaagttgtagccatcgtaacatagtgcagtgttttcctcccatgtttgcggtgatgctgtgaaaataaacctattgcactaccagtcttataaaacggtagcacgtagaattatgtacagtattaatgcttgataatggcaataactatgttgctggtttatgtatttactataccataggttttattgttattttagaatgtatgtttctacttataaaaaaggttaactgtaaaacagcctcaggcaggttgtcaggagttattccagaagaaggcactgttatcttaggaagtgacagctccatgcgtgttactgcccctgaagaccttccagtgggacaagttgtggaggtggaagacagtgacactgatgctcctgaccctgggtaggcctcggctaatgtgtgggctcatgttttaatttttaacaaaaaagtttaaaaagtcgaaagagtaaaaattaaattaaaaaagcttataggataagaatataaagaaagaattttttttatagctggacaatctgtgttttaaactaagtattattacacagtagtcaaaaagtaaaaaacaaaaacaaaaaaatactaaaacgctcatagggtaaaaaagttacaataagccaaggttaatttattactgaggaaaaatatattttcttataaatttagtgttgcctaagtgcacagtatttataaagtctacggtagtgtaccgtaatgtcctagccttcacattcactcaccactcactcactgactcacccaacgccacctccagtcctgcaagctccattagtggtacctgccctaaacaggtgtaccatgtgtgtcttttatactgtattttttactgcactctttgtatgtttagacatgtttagatacaaacatacttaccgttgtgttacagttgcctacagtattcagtacagttacatgctgtgcaggtttgtagcccaggagcagtaggctgtaccacagagcccaggcgtgtagtaggttatgccatctaggtttgtgtaagtgtacttagtgatgttcgcacagtgatgaaattacctaacaatgcatttttcagaacatattcctatcattaagaaacacatgatatttggccatgttggaatggattttagggtctctaacagttgaggatagtctagttcatgtagatttgaacctgacaaaagtgacttatgagaaattgcaagaattcttggcaggtttctttttatgaagaactccctttgtgctcattttgtcacctttacttttgtcacctttactttctataacaaaataaaccatgttacatgaaataattctattgaattttgattttgagagagaactttcaccagttaacacgttgctgattttgttttcctctaagtttttagattaatatcagattaggcaaattataccattagtgatgaaacttaatgtgaatgattgtttctgaggggaaaaacctcgaaaccgtgagatttttactctctcagttaaataatgcaatgctgattgattcagttttaaaaacagtttttattttttaaagcagcagccgaattctcttaagtggagggatcgcataggtgtcctggagctccaccatggtgagtggagtcacactttacaattttatttatccagctttatttgttgacttacatttaataagaatgattttgtcacaattctaaaaggcgaaatgatttctagaaaaaataatataaatatatttactaatatacccgtcctttgccaatctcttgtcctgcacatgtgtttagaagtaacaaaaacaagctgtgtcctatggcaagcttacgggaggccctcccctggttgggcatgttggacttgatcatactgaacaaaattcatctcagagaacaagaaattactgcagactttagcagcacccgaagtgttactctgtctaattggatcatcggaatagtcaagtttttaaaagtgtcactcacgccgggcgcggtggctcacgcctgtaatcccagcactttgggaggctgaggcgggcggatcacgaggtcaggagatcgagaccatcctggctaacacggtgaaaccccgtctctactaaaaatacaaaaaagtagctgggcatggtggcgggcgcctgtagtcccagctactcgggaggctgaggcaggagaatggtgtgaacgcgggaggcggagcttgcagtgagccgagatcgcaccacaccactccagcctgagcgatagagtgagactccgcctcaaaaaaaaaaaaaaaagtgtcactcacagaaatagctaacagaagaaattgccttacaggaaaaatcacgacttaagaaggaagtcacttatctttgtaatagaatgtgtcatcagactgaagaagcagcagctctccaagttactcctcgccattaaccaaaatttggaggtgtacactttcaaggaccacagttatttcttagaacatacagtgcaattttaaaactgtgttcttgaaaggaatcgtttacaaaaagttatagcacaggagtttttcatgaaaatgcaaatgtcacttctgctgaatggaaggctaaagagaaaaggcaaagaaagagactcaagacatacgaagtgggcccggtcgtggtggctcatgcctgtaatcccagcactttgggaggccgaagcaggcggatcacctgaggtcaggagtttgcgattagcctggccaacatagtgaaaccctgtctccactaaaaatacaaaaattagtggggcgtggtggtgggcacctgtagtcccagctacttaggaggctgaggcaggagaatcgcctgaacctagggacagaggttgcagtgagccaagattgcgccactgccctctagccttggcaacagagcaagactctgtcttaaaaaaaaaaaaaaaaagtggaccatttctaggcattggatggttgcagaggagatgccctcatgcacctacagaagtggagggcatgcccaccaggtcagtccccataagtagacgtgcaaagctcatcacgcctccctgttgtcaccaaatgtctcagacctccatgggctgcatgtggacaaagctagagaatattttatgacaatgctacagcaaaaacctgaagatttaagcaaaatgcctctctgtgattatgggggttgaaaagcatagccagggagcagccactgtcatcagaccagctgctgccataaaatgtctcacagccacaacttctggatctctgaagttaaaccagactttagctctgaagtcgggctaaagtaaaagacacttccttaacttagaactgtgaagaatttaatagagaaacaaggctgaacacatctgaattttgaagagctatttatgacttcatgtcgtatatgacaaattttattatcgttctctttaaaatcgagcaattgattctcatcatccaaagggtgaacctgtttttaataaatgaattaactatgagactgctcattaaaatgtaatattgcaactatctatggaagaatagattatacaattttcagccagcataagaaaaacaaaaagattttatttgaactattaaaaaaagtaattttcctgtcaactctgtacttttttatatacatttttataactttgctttaaaaatttcttgtgaaacgatttgcaaattacatatagtataatagtaaaataaaatactttggccaaaaaaaggatatttactaatatgcaatgtagccacactttagaagcttatacagactttataattgtccttgaaggccagaagtttgttttgtcagtcactctgcttccttgggttccactggcttggaggggctctcaccagcatcttccattgtccctgaaagggttgtagaggtgtgcattagtttcctggggctgtcataacaaaatactgtatagtgagtgtggcttgaccaacagaaatgtatggtctcacagttctggaagcaggaagtccaaaatcaaggtggtggcagggttggttcttctgagggctgtgagggaaagatctgttcctggcctctctccttggcttgtagatggctgagctatagttttgttattttttccctccaaatcccatgttgaaatgtgatccccaatgttggaggtggggcctggagggaggtgtttgggtcatgggggcagatccctcatggaatggcttggtgccctccctgtggtgatgagtgagttctttctctgtgagttcatgcaggagctggttgtttaaaggagcctggtgcctcctccctctctctcttactctttcactcaccatgtgacatgcctgctcccccttcaccttccaccatgagtaaaagcttcctgagggctcaccagaggcagatgccagcactatgtttcttgtacagtgtgcagaacaatgagccaaaataaacctcttttatttgtaaattacctagtctcaggtattcctttatagcaacacaaaacagactagtacagctgccttctccctctgtctcttcagatcatcttccctgtatgtatgtgcatctctgtgtccaaatttcccctttttataaggacaccaggtcatattggattaaggcccaccctaatgaccttattaatttccctttttataaggacaccagtcattgggttagggtccatcctaatgacctcacttgaaatcctgcctccagatgagatcatgctctgaggtattagggattaggatttaacatgaaagtgagggggatgcaattcagcccatcacagggtggattccccttctggggctgtgttactcaaaccatcccaggaagggtaacagggccagaggagctgaagaattgtgagcccttgtttaccaggcttggggggttctgtcttgcactactaccctgaaaaccctactggttgccaattgaatttatcagggaactccagtgcccagtgacaaaggctggaaatcttttctcctaaagatctttaagggtgcacctgccctcacagtccctctggctctgagcttgtggctctatctgttccctatgcccacatgaatgagttctgcctcaatccctgctccccactgtggggaaccaagtaccaacctcaacttgctgggcagatgctacgtgacagtctaagtgctaagctctttacagacatggtctcattttatcttcctcataagccaaagaggtaaagaatgacattactgttttacagatgagaaggccacattgtgaagaaattaagtgatttgcccgaggtttgtgttgatcatttcattaaatgaagtatcatatctatcatactttttcatttattagaaacaaaataccactcacggtaagaacaaagatgtggaggagcagtagaagaacagagaagtaggagtggaatttcatgagtccccaaaccgaagaccaatacctatgattagaaatacaggggactccatgttcatagtggcgttattcacaatagccaaaaagtgaagtcacccaggtgtccttgtgtggatgaatggataagcaaaatgtggtccatgtgtataatgaaacattacccaacctcggaaaggaaggacatcttctatacgccagaacatggatgaacctcgaggacattatgctgagtgaaataagccaggcacaaaagaacagacactgtgtgattccacttacatgaggtgtctggagtgctcagtctcatggagacagaaaatagaatggtggttgccaggggataaggagttggggatagcatgtttgcatttaataggtacaaaatttcattttaagaagatgaaagttttatagatggttggtggtgatagttgcacaaaaaggtgaatgcatttaatgccactggactatatacttagaaatgactaagatgatgagtgtttatgtgtattcacaacttaaaaataatttttaaaaaagaaaggaaaggcactgaccccaacccacacactcaacagtttttgaatccagattttctggcaatgatataaaatgtcttttgatccaatcactcaggaaggtcaagagaaaaccctgcatttttattgggaagaatagcctcgaagcaggagcatcgtttagaacctgtcttgtgcatcttcagtaaacatttgagtaataaatcactgttgcacttgaaggaaggtctccaggttctggtggtaggtgtggggttggcaagagtgcagctttaaggtgtgagctccgggatttctcactgaggataagttcatctttctaccagttctgcacagttgagtctaagcacaggtggtggtggggaggtaaacatggagatgaccaaggaaacacactctgacccatccctgattgcaaaatgaaagggtgttggatccagaatgtggttggtacttgataggtgcactgtccctgacaaaaacggggcagaggggtgacctacacactcctatttctcatctccagtttgttccttatcaactaccactttctcttcctgcctctcctgagtcttgaagtttgtaaagtctggtctggcttactcctcataggtatccagcatttagttttgaaacatatcaacacttgtacaaatggcagttagggtgactgttatgaaaaggaaatctaatacactattcctccacttgaaatcctccatgtctccccattccctgaggcacatgattgaagcccgaagaatgcatgccccacctgctccctgcccattggtccagctgccacccagacaaggtctggcaccagatccatagtcagcagtgctggccctgcagcctctgctaacggggctcaccagcctgcagcctcggctcctccatactcacctgcccaccactactagctcagcctacaaccttagccaactccttagcctccaggaagacctccaggtggttcctcaacttaggtgtctcttctaaccttaatcctggaagttgacttgctggttgcattatgattcctaagccccagctgtggagggagagtccctggaagatgggacaatgtctttgcccctgaacttccatccctggcatagtgccagctttttcatggagggtattcagtaagcactgcatgtgaaatgcattgtgccaagttattttgcctcgtttaactcttgaaaagcaggcttctgtgcagaccaggctcaaatccatgcttccaggtgccctgtgcggtgccaccacagtgtagcacacagacctgcacgtgcctacatggcattgattccaggccttggtttcctctttgggaagataaagtaactgtactaaatgcagagagaaattagttaactttatcacttgcttttagaatgattcttgaaatatgaataaaaaatataaatttctggcttattttggcttttcttttcctagagtaactgaatttttaaaaatcaagcaatgcaggaaggaataaaaacaaattcaggtttacatatatgagactggcagcacaatacaactaacctctgctagttggtgactaacagttggaaatccatcctggaagttcccaagcacatcagtgttgcagaggaccttgaaagcacagcaaatgggtgagcacacattattaaacttttattaggttgtcagccttgtgtatctctttcaaaaacgtgtagctcataaaaacattcttcacttatcttcagctgatttgatgcaattttcttcaatggtgcttagttatatttaatccctgtgccatacttatgtccaaaaaaatgggaaataatgcaaagcaggccatattctaaaatgaaaagcattaaattaaggttctaggttccctcaaaaagagcaaagcagagtggacctcaccttatatagcatctatctctaaactttgcattttattttgaaactctgcaaagcaataaaaaactcattaacttttatagccagtcagaaaggtagtaatagcatctgtagcaatggagatgtaattaggcttttatttaaatgtggcagggagtttgttctcattatacgaaataaatgaacaaccacaaatcaccagtggattcatgctccctatggtgctggtgcaagtggtccaggaacttgcccagtgctgcttccttatgtggcaacagagcctgtgagccccagagccagggctggatggaaaccagctttctgaaggttgaatagtcacagcaattatattaacgattataatcatgacagaaaagattctccgtccacattgttgtgttaaaacagaaaaagaaaaaaaaagtgttgcagatcatcaatgcaattcttaacttggtcatagaaaaacaccgaatttgatcatcctcttgtctctgctgtagctaagctcctttcctggcctccaattcctgtttccttcccaatacagcaacttccttctatctgtattatctccttgcccatttagatagcctcagaaaaacatggggaagaaccaatttgaaaggtctcagtgggtttcatcaggttcctaacagataataaatgctgagctaaggaccctaggttcttccaaaaaatgatgatattaaagctctacatcctctttttgaaagtatgtaaaactactttagtggttttgattcattttaatcttatgtcagctacattattatgtaagggaaattcaaagatgaggatagaaatttactcagaaaaagtataaattgatttctgtttaaagatgattttccggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgaggtggcaggcgcctgtagtcccagctacttgggaggctgaggcaggagaatggcgtgaaccccagggggcggagactgcagtgagccgagattgcgccactgcactccagcctgggcgacagcgagactctgtctcaaaaaaaaaaaaaaaaaaaaaaaaaaagatgattttccttaatctcatctctcaaaacccacaaatatatatgtattactaggtatgtgtgtgtatatatatatataaaaaatgtatatatatgcacacatgtgcatatatattttttgttgttgatttgtttgtgtatatgtatatgaatgtatacacatatgtgtatatacacacatatttatacactcatgtatatgcacacaaatcaacaataaaaaatagagggcaaaaaatccaatttatatataacaagaaaatggctacattctcaaaacatcttgactggagctcgagagccaataaaaagttgatctctgccacctgagaccttgggccaggatacacgtgctcttaaaagggcaggttccgtgttcacttgtatgttccggccccagctgctttccctgatggaagagggccagaggcacacagcgggaaagtggagaagctggaagggcttaagagtctaagtctggggaaggtgaaggagtgtccccagggcgaagaaagagcaggtttgttggagggcactcaagaacacacccacgtgaaagccgtagataggctttccctatcccgcatcccgccacactcccatcccacccctcggcagtactagctcagccaatggggctactgactgtcccttctccaagatgagtcatattgagaagaacggcctgggcccatggagaacaactgccatcaaacaatcaattggcagcatccatcaaatacctgatggagggaaaaaaggaaagacagaggcacatcggggcagatatcacgaaagacagttttcaaggacacagagagggattctcaccaacagtgcttcattctgcacaaagattctatgcagcaggcagcattttctgcacctgaaacgagaactgtcacggaagagtcaggatattcaagtaagaggccgtgtgacagtgggagaggatgtgaacagagctgtcagagtccattaggacatggaaaggaggaagaacactgcagaaataaaaaatccatatgaagcgacaacaaaggaaaaacaagacagatgatatcatgaggtcttgacaaatagacctgggaaaatctcataaactacgtattaaagagaaccagggaacttaaaaatgcttttagcaaaacaatggccaggagagggcaagatagacaaggacagctcggctctcagcaggcgcttctaaccctctcactgtccccgccgccagccctgggggaagaacactgtgtttttgtttttgtttttactacagattcttaaatattttaaattttgaaccatagatatatgtttccattttagcattaatcaataaaatggctgttggaaactcagtgaagaacaatacaagaaatgtgataaaccccacaatgggtatacgaccatctttgatcaattttacaactgctactgctcacccctcaatgcccatcagtctctcacaggaatgcaccaagagaagagaatctccagcaggaggcccagaggtggaagaggcagggatgcgaagaagcagaggaggctggaaggaaccggcgagaagtggggacagcgggagtgtaagtgagagccagtgaggccgctcacgcagggcacccggccaggtgaaaacttttagaatttgcttcaaaagtcagtgaagtgctctaagcagcacagtgtcaaaatcagatttaaagttgtcaaagggcatttttaatgcaaaaagcaacagactgggcaaaagtgtttttaatatgtgtaaccaaaaaaagagagttaaaaactagtattttttttcaaaatgttcccagaaataacataaataaaattagttagaaaacaaagcagacaattaaaagaaaaagagatacaattagtcgataaatctatgaaaaaatggtcactgtatcgtaaggcctgaaatttcatttcccaccttaacgccttcgaccctcacaaggccccaagggtctaatcctaagtccttatgctcacaccagacgtgtacccccgccagtgggaaaggctccttgcctggccagttccccattagctggactagcttcacttaacctgatcctcactctaatgggcttcgcttccctgccagctcatgaaattattcaaaaaagctagtcatatcctcacatggggcctggaggcacctcagcatcttgttagttcaaagcctgcctccttttcactagagtccctgcaggctctctgtgttcccatgtgcaagtcccttatggccctgtgtaaaatgcaatgtcctcctccccgaggccttgagcatatgtaagcaacaaaccgctatgagcttatctgtccagtcccgcagggtggatgcaagtggtcagaacagtcacctcatttgtaatcagagaaacattaactgaagcagcaatgatacggaatatttttacccaatggattcataaaattatgaaccagtattaactacctgtgttggcagtggtttgcatgggaatatatattggtggtttttcaggggatatctattaaaatatacaaatcctgtgacctctgatttaccttctagaaacatttacttagatgcactgttggtaacagagaaaaaattggatagagcttaaatagctactaaaagacaatggttaaatgagttttgatatgacaactgataggcaattttgtggactggctcatttccaatcttcttcccttgtgtctccctggactgcagagaccagaaagccagaaactacatttgctaagctccctggattacaggcatgacttagctctgccaatgagatgtacttatgtgtgatttgactttggatctgttttaggtgagatagaaatagcataaagcagtgttttaaaaaatactttattgtttagaatggtgttaaatttacagaaaaattgcgaagctacagagatcttgcatatgccagcataaccttttccccctattattaacatcttacattcttaaagttaatggatcaatagtgatatatgattgttattaagtaaataccacagtttattcagatttccatttatttatttagagacaaagtttcgctcttgttgcccaggctggagtgcaatggcacgatcttggctcactgcaacctctgcctcccgggttcaagcgattctcctgcctcagccttctgagtagctgggattacaggcatgcgccaccacgcccggctaattttgtatttttagtagagacggagtttctccaggttggtcaggctggtctcgaactcccaacctcagatgatctgcccgcctcgacctcccaaagtgctgggattacaggcgtgagccacagcccctggcccagatttccttattttttgtagaacttctttttctgttccaggtgtctgttcataactccacactgcacttacctctcacggctccttaggctctcttggtggtgacagattctctgagttttcttgtttttgatgacactgataaatttgaggagtaatggtcatacttggtaagatgtccctcgaatggaattgatgtgaattctttctctgattaggcaggtgccagcatggcccaccactgctgatgtggaccttggtcacctggctccgggagtctttgtcaggcttcttcacgtaaagttgctctttttttcccactttccacaccgtactctttggaacgaagcacctcgtgcttaaggagtggggatttaagcccactaggatagtttcagcactcaaaaaacgtatgctttcagaaagacaagcatcacatgttttcacttatttgtgggatctaaaaatcaaaacacatggagatagagagtagaaggatggttaccagaggctgggaaggggagtggggtggggggtggaggggatgtggtgaaagttaatgggtacaaaaaatagaataaatgaataaagcctagcatccgatggcacaacagggtgactataatcaataattcaattgtatattttaaaataactaaaatagtataattggattgtgtgtaacacaaaggataaatgcttgaggggatggataccccattccccatgatgcaattgttatttattgcatgcctgtatcaaaacatctcatacgcctcataaatatatatacctactatgtaccaacaaaaataaaaaatagaaatcctgcgctttacctatttacccctcccatcccctctggcaacaactatttttactgactccatagttttgcatttctttgaacctcatatagctggaatcatatgctatgtagccttttcaaattggcttctttcacttagtaatatgcatttaaaatttaaccatgtcttttcatggcttgatagctcatttctttttatggctgagtaacagtcacttgtgtgggtgctctctactttgtttacctcggttgctttcagttttggagtttatgaatgaagctgctaaaacacactttcatgcagcttttggtgtgaatataagttttcaaatcaattcttactaggaacttgattgctaaatcacatagtaagactatgtttagctttgcaagaaactgcctaactatcttccaatgactgcaccatttttcattcacaccagcagcaaaagagagttcctccatactgaatcctctccagcatgcggtggtgcaatttttgcagattttatctactctaatacatgtctacctgtatgtggtttcaatttgcaattcccaattgggaaatgatttcaaaaattattttaggttgccatttgtatattttctttgctgagttttctgttcagatcttttaacttcattttaattgagttgtttgctttcttattgtttaactgtaaaagttctttgtaagcttcagatataagttctttatcagacatatgttttgcaaatattttctccaagtctgaggcttatttttttattatcttgcaatgtctttggcagagcataagcttttaattttaatacagtttaacttacctatttttctttcatccaccatgtttttgatgttgtgttgaaaaactcattgccaaacccaaggttacctacattttctctattttcctctaaaagtttcaaagtgttgctatttacatttaggtttatgattcattttgagttactttttttctttctttcagctatattgaactataactgacaaataaaaataatatacattcaagatgtacaatgtgatgtgcatatactatacacgttcattgtgtaatggttaccaccatcaaattaatcaacctatccatcaccacagagttaccctttgtgtgtgtgtgtgttgtgataacacttaagatactttttcttagcaaatttctagtaaataatattattaactataattatcatgtggtatattagatactcagcaattatttatcttataactgaaagtgtgtacccttaaatcaacatctccccatttttcccacccctcagacactggcatgcactgttccactccttgcttctatgagttgcactttttagattcatatatgtcagatcatacagtatttgcctttctgtatctggcttattccacatagcataatgtcttccagattcacttatgttgtcacaaatggcaggattttcttcttttattatggctggataatatttcattgtatatatgtgtgtatatatgcatcatatatatgtatatacatgcatcatatatatgtatatacatacatcatatatatgtgtatatatacatcatatatatgtatatatacacattgtatatatgtgtgtatatatacatcatatatatatgtatatatacacatcatatatatgtgtatatagacaatagtttcttgatccactcatctgtcaatggacacaggttattccatgtcttccctattgtaaataatgctgcaataaacatgagggtgtagatagcacttcaagatattttatttcctttcactatccttttccttttctttggatatgtacctaggtataggattgttggattatatagtagttctatttttaatagtttgcagaactaacaatgttttctatataaattgactatatcaatttatatacccactgacagtgtacaaggattctcttttctccacatccgcaccaacacctgttagttcttgtcgtttggataatagccatccttacaggtgtgaggtgatgtctcagtctcactgtggttctgatttgcatttccctgatgattcatgatgttgagcagcttttcatacacccgttggacagttgtatgtcttctttgaaaaaatgtctgttcagggcatttgcccatttttcaatacgttactatcatcatcatcattattattattaatttgctattgagttgtatgtgtattcagtattttgaatattaacccattatcagatatatagtttttaaatatgtgctcccattctgtagcttggctttttgttttgttgattgttttctttgctgtgcacaagatttttagtgtgatgtattcccatttatttatttttgctttcatgctatgtgcttttggtgttatatccaaaaaatattgccaaggccaatgtacagaaactttttctctcttttttcttctaggaatttcacggtttcaagtcttacatgtaagttttcttttttttttttttgagatgaagtttccctcttgttgcccaggctggagtgccatggtgtgatctcagctcaccacaacctctgcctcctaggttcaagtgattctcctgccttagcctcctgagtagctgggattacaggcattacaggcatgcaccaccacgcctggctaatttttttttttcttttagtagagatggggtttcaccatgttggtcaggctagtctcgaactcccaacctcaggttatccacctgcctcggcctcccaagatgctgggattacaggcatgagccactgcgcctggcccatataagttgttaatcctatttcaagttaacttttgcatttggtataaaataatggttcaattttattcttttgcatgtggttatggagttttcccatcatttattaaagagagtatcctttacccatcgtgtattcttaggactcttctcaaaggcatttaatttggggctctctattctgttctaagagcctgtttttatgctagtatcatactgtttttatttactgtaccttggcaatatagtttgaaatcaggaagtataattcttaacagctttgttgctctttctcaaaattgctttgcctattcagagtcttttgtgattctgtacaaattttaagattgtttcttctatttctgtgaaaaatgtcattggatttttgatagggattacatcaaatctgtatatcactttgggtagtatggatctatttgcgatgttaattctttcaattagtgaacatgagctatctttccagttatgtgtgtctcctttaatttctttcatcagtgttttatacatttcagcatacatatctagatatttcacatgcatgattaaatgcatttctaactattttatcgtttttgatgctattgtaaatgggactgttttcttaattttttggatagttggttcttgatgtatagaaaacccactgacttttgtatgttgattttgtatcctgaaactttactgaatttagttattagttctaacagttttttcatggagtctttagagttttcaatatttaagatcatgtcatcttcaaaccgagataatttaatgtctttctttccaatttgggttccttttacttacttttctctcttaattgctgtggctaagacttccagtactatgttgaacagaagtggcaagagtgggcatctttttcttgtacctgagtttaaaagaaaagctttcagctatcatcactgagtatgatgttagctgtgggatggtcatatacggcctttcttgtattgaggcacagttcttccatatgtaatttgtgaagtttgtatcatgaatttatgttgaattttgtaaaatgcttttattgaatctatggaggtgatcatatgattgttatcctttattctgttaatgtggtatatcgcaattattgttttgcacattatgaaacatccttgcatcccaggataaatcctacttgattatagtgtatgatcctttaaatgtgttgttgaatttggtttgctaacattttgttgaggagttttgcatctatgttcatcagtgattttgtcctgtaatgttcttttcttgtagtgttcttagttagctttggtataaagataatgctggcctgataaaattagtttggaagtccttcccactcttcaactttttggaagattttgaggagaattgccatgaattcttcttcaaatatttgatagaattcaccttgaagccatctagtcctgagattttcttttctttgaggttttagattacaggtttaatctcctttctcattattgttctgttcatattttctctttcttcatgattaactttttgcaggttgtacatttctaggaatttattcatttcttctaggttattcaatttgttggtgtatagttgttcatagtggtctcttatgatcctttgtatttctgtggtatcagtggtaatgcctcctctttcgttacgttttctttattgtgagccatcttttttgttcttggttactctaactacagttttctcaactttgcttatcttttcaaaaacgcgactttagttttgttgatatttcctattgtgtttctagtctctattttatttctttttattctaatatatattttttaattttctgactttggactgagtttgtgctgcttttctggttttttttgggctaagtagcttgtatatttgagattattcttatttcttaatataggcatttattgctataacgtttgttcttaaaactgtgtttcctgcatcccatacgttttggtatgttgtgtttctatttttacttgtctcaagatactttaaaatttctcttttgatttcttatttgagccattgatttcaggagtatgctgtttaatttgtacatatttgtgaatttcccaaaatctcttgtgttattgatttctaatttcatacaactgtggtcagaaaagatacttgatatgatttcaacactcttaaatttgctaagaattgtcttatatcccagcatatgatctatcttaaagaatgttccatgtgctctggagaagagtaagtatgctactgctgttagacagaaggtcaagaccttctgttgggtccctaggctaatgggattacttctgagattgcagtcaagtggagtcagagctgagttacaactgctgctgggcccacagtggggaccatgtttagtgggcctcttcccaggtgctcaagctggcatggattatacctccatgactttggtcagtagggctggtgatgggacaagtgtctgtctactcagggtccatagttggttgttaccaggtgtgtataccggtgcggatccttctaggtccttgggatagctcctcctgggtcactgggtaagtccctgggcaggcatgactgcacaggtaagagtgactggagaagagttacagggccattttggagtctactgtggtatcaaggtaaacaagcctgcctccctgggtgtgaaagattgagcatgcctcctgggggggtctttgagtgggaaaaactgctctcagctcacagatgagaaggcctagagccaagttacaaaactattacaggaccttctgtgggtctgagattggtagaccttctctgaatgcacagatagctgtatctcctggcaagactgtgcttgggcaagaatgctctcaaaacacaattgagagggtctatggctgagttacaggactgcttcagagttcactgcccaggctgaggtcagcgagcccatcaccagagggagcagtgcccgtgactccaccccagtcctttggcagatgactgtggtagcaggatcaaggccaaacaggcttatagccgagcccacaaggagatgaggctgattccagacctattgcctgcaccaacagtcagcaagcctgccacctagatgcaggcctcccctttcctcaacctcctaggttttaagccagaccagggtttcacaacctcccacctggatcccaaaggctcttttgtctaaataaatctctcaatgtatttaaatattctttgattcctgtcatcagagtttagtagtttcctgcatatagattttgtacatattatgttagctgtttacctaagaatgtcatttttggtgccattgtaaatgtttttgtgagtataattttgaatttcaaatgtccatagttggtgtatggaaaacaaatgactgttgaatattggccttttatcctgtgatcttgctgtaatcacatcaataccaggactttgttttgaccatttcttaggattttatacataaataatcatgtcatctgtgtatgcaatagactgaataataattaccaaagctaaccaagtcctaatatttggaaccagtgaatattatgttacgtggcaaaagggatattgcacatgtggttaaaagatggggagattgtctgagattgtccagagtgcctgaaatataattgcaagtgtccttataaaagggatgcagaagtagctttgattatgggtaggagaaggcaatgtgatgagagaaatggtgattggagtgatgcggccacacttcaggggatgcaagcagccaccagaagcagaaagaagcaaggaacagactccactctgcaagtgaccaaccccaataacaccttgattttagtcctatgtcttagtctgttttgggttgctataacaaaataccacaaactgagtaatttataaagaaaagaaattatatttctcacagttctggagacttggaagtacaatatcaaggtgacagtatctggtaagggccttctggctatgtcacccatggcagaaggcaaaaggtgagagatggtgagagagctaagagggaagccaaactcatcatttcatcaggaacccactcccacaataactaacccactgccacaataatggcactaattcattcataagggaagaaccctcatgacctaatcacctcctaaagttcccacctcagcattgttgcattggggaataagtttccaacacatgaactttggggtacacattcaagtcatgacaccctatatgactaattttggacttttagcctccagaaatgtaatagaataaggatgtatcattttaaaccatggactttgtcataatttgctacatcagcaataagaaactaacacaatcaataaagacagatttatttcttccctctgtacctacacaatttttacttcctttcttgtcttattgtattagctatgacttatagtataatgttaaatgggagtggagggaaaagatctccctgccttgtccctgaacttagggggaaagcttccagtttcttaccacgaagtagtatgatgttagctgtaggttttttgcagatgttccttgtcaagttgaagctgttatcctctattcctatttgctgaaagtttatatcaaggatgggtactggactttgtctagtgctttttctgcatcaatagatattgtattagttcattcacacactgctataaagaactaccttagactgggtaatttatgaagaaaagagatttcgttgactcacagttctgcagacctaacagaaagcatggctgggaggcctcaggaaacttaaaaacatggcagaaggagaaggggaagcaggcacgtcttaccagggcgaccccatgatcccatcaccatcaggcccctcctccaattcgacatgagatttgggcagggacacaaatccaaaccctattattctgcccctggcccctcccaaatctcatgtccttttcacatttcaaaatacaattatcccttctcaacagtcccccagtattaactcatttcaacattaactcaaaagtccgaagtccaaagtctcatctgagacaaggtaagtcctttccacctatgagcctgtaaaaataaaataaaataattagttacttccaagatacaatgagggtacaggcattgggtaaatgctcccattccaaatgggagatattagccaaaacaaaggggctacaggccttatgcaagtccaaaacccagcagggcagtcattaaatcttgaaactccaaaataatctccttggactccatgtctcacatccagggtacactgacgtaaggggtgggttctccaagccttgggcagttccacccctggggaggagctgtgcagggtacagcctctgtggctgctttcatgggctggtgttgagggcctttggtttttataggtgcacagtgcaagctgttggtagagctatcattctgggatctggaggatggtggccctattctcacaactccactaggcagtgcctcagtggggactttgtgtaagggctccaaccccacatttcccctctgcactgccccagtggagattctccatgagggctccacccctgcagcagaattctgcctgcacaccaggtgtttccatacgtcctctgaaatcgaggcagatgttctcagacctcaattcttgtctttggcacacatgcaggctcaacaccatatggaagctgccaaggcttggggtttgcaccttctgaagccactgcctgagttgcgccttggccccttttaggcatggctggtgctggagtggctgggatgcagggttccatgtcccaaggctgcacagagaagctaggccctgggcctggcccactaaatcatttttcccttctaggcctccaggcctgtgatgggagggggtgctgtaaaggtctctgaaatgccttggagactccattcttggctattaacatttggctcctctttacatatgcaaatttctgcagcaggcttgaatttctccccagaaaatgggtttttcttttctatcacatggtcagtctgcaaattttacaaacttttgtgctgtttcccttttaaatgtaagttccagtttcaaataatctctttgttcatgcatatgactgtacatgtttagaaacagccaggtcacctcttgaatgctttgctgcttagaaatttcttccaccagataccctaaatcatctctctcaagttcaaagttccacaggtctctagggaaggggcaaaataccaccagtctctttgctaaagcatagcaaccgtgacctttactccaattcccaacaagttcttcatctccatgtgagaccacctccacctggacttcgttgttcatatcattatcagcattttggtcaaaaccattcaacaagtctctaggaagttccaaaccttcccacgtcttcctttcttcttctgagcccttcaaactgttccaacctctgctctttacccagttccaaagccgcttccacattttcaggtatctttatagcaatgccccactcccgtaccaattttctgtattagtctgttctcacactgctataaagaactacctgagactgggtaatttatgaagaaaagaagtttaattgactcacagttctgcaggcttaacaggaagcatggtagggaggcctcaggaaacttataatcatagcagaaggcaaaggggaagaaagcacatcttactgtggtgacgggagagagagagcaaaggggaaagtgccacatacccgtagaccatcagatctcatgagaactcactctgacaacaaaaaaagcatgggggaaatcttcccccatgatccaatcacctcccaccaggcccctcctcaaatttgacatgtgatttgagtagggacacaaatccaaaccatatcagatatggtcatataaattttatttttttacctgttgatgtggtagatagcattgttttccagtgttgaaccagctttgcatatctgaaataaattggttgtggaatacaattcttttataccttgttggattcaagttacaaatattttttgaggatttgtgtatttgttcctgagagatattagtctatagtttttcttactcttactaataatgatttatctgattttagtatcagagaagtgctggcctcatagaatgcattagaaagtgttccctctgcttctattttccagaagagattgtagagaattattgtattttctgtcttaaatgtgtgatacaatgcaccagtgaaactatctgatccttctgctgacattcttggaaggttattaactcctgatttattttttatacatattgacctgtaatgattatctatttcatctttgatgagtttggtagtttgcattttgcaagtaattggcccatttcatataagttatcaaattcggggtcacggagttattcatcatattattttactatcttttcacattgaagggattcctgctgatgacatatcttaaatttctgatattaataattttggtcttctctgtatttttctcagtctgactagaagtttatcaattatattgatctctttaaagaactagcttctgattttattttctcttattttccattttttatgttcatcgacttctgctctaattttgcttatttgtttgctttaggcttaaatttatttttctattcataattcccaaatgtggaagcttagattattgattttaaatcttcttcctttgtaatatatgcatttaatgctataaatttttctctaagtattattttcattgcattctacatattttgataatttgaattctcattttcagttaggtcaaaatattttgtaaaaatttttcttgaggctccttcttgacccatgtgttatttgaggttaatttataagcattttaggatttttgtggtatatttctgttgttaatttctattttaattctattgtcatctgagtttatattttatatttaatttttatttaaacaaatacgttaaatatgttaaggtgtgttttatggccaaacatgtggcctttgtgagtgtttcaatgtgagcttgagaagaatgtatattctgctgtcgttcaatgaattattctataaaagttaattagattcagttgattgatgtttcagttcagttcaacttacatcttgttggagaattagcctcatcaatctttgtgtaagtctctgctttatccctgctatttttttttctttggaagcctgctttgtcttaagttaatagctgccctgagagcatcctgaaagttggaatgggtatgtggggcaagactctgatgaagctgggatcgttaagcccctacattctgatgaatcttctttgccagtagaaacaactctccagcccagtaggaatggctgctctgaacctatttggggcaattaacactgtatagcctgaggtgactgcaatgggccccctgaggtagttgccatgcaaaacacagctgatttttttcaggacccaccccataactacactcacatcacaacaggactctaaaggcgaggtagaaagtgtgacccatgaagaggcgtgacacactccaagggaattagttgtgttttcttatttatacagacaaaaatccaggctatatgtgcagaaatgaatagtaagtgtgtgggctaatgagagaaagttagatcagggtaagtttattgatatgggcccactaagcagagactctgcatttaatattgtagcttggggagtcagaaaggactctaacagtttggttggtggacccaaaaagggatcaaaaggtggcccacagcaagggagttaaaatataaatgccaggtgtgccttggtttaatgccgaagaagggattaaaggcttaaagacattgggatgttagagtggattttccatttaagacctacttatatgccctgggaggcttcaaaagacatacctttcaccaaaatggtgagaaataaatttttgaggagagcctcagcatccttgatgtgtttgttctctataggcaagatttttagtggaaactagagtcactgaattgggaaaactaaatgtaatgggagtaactggatcccaggttggcaggagccaagtaccagcattcagccaccaaaatccaggtgggcctagctgacacagtggacagcaatgtcacagcagccactagaatagtctcactcgtggagacctatggcattggctagttgatcatggtgctcctagaagtgaaatagataggaagccaactaaattcttacttgatctgtataagcagaaaaagttgtaggtcaagtgaataaaagtctaactctaatactgaaaaacagagaatcatgatccctcaatcaattatcagaggcaaagtaaggcctttattcttcctgtaagggataaaagccaagtccccttgaggaagaaacccatgacactgccaaaaatttataatgttaatctctttctcagccttccccagaggagcttatggccttttaacaagatgactaagcattagggaaaagtaaataatcagacattttggtgactgctggacactggctctgaattgacactaattcctggtggcactgaacaccactgtgactcaacagtcagagtaggggttatgcagatcaggtgatcagtggagttttagctcatcttatagtagattcaggtaatctctgaacccatcctgtggttatttcccagttccagagtgcataattggaatggacatattcagcaactatcagaatccccacattggttctctgacctgtggagtgagggccattatcataggaactgcctgtacctaaacaatgtaaaccaaaagccatactgcattcttggagagattacagaggttagtgctactctcaaggactttgaaagatgcaggcgtggcagttgctaccatatccacattcaattgtgctatttggactgtgcagaagacagatggaccttagagaatgacagtggattcatgagcttaatcaagtattaactttaattgtagctgctttagcagatgtggtttcattacttaagcaaattaacacatcccctggtacctggtatctgagatctggcaaatgcctttttttttctgtatctgtttcgaaaggccattagaagcagtttgctttcaacctgcaaggccaacaatacaaattgagtgtcctatcccaagggtatatcagctctccagccctgtgtcataaattcagttcatacagaacttgaggccttttccttccaccagataccacgctggtccattatcttaatgacattatactgatttaacctagtgagtgtgaagtagcaaccactctgaacttattggtaagacatttgcatgtcagagggtaggaaataaatccaactaaaatgcaagggcattctacctcagtgaagtttctaggggcctagtgctgtggggtgtgtcaaaatatcccttgtaaggtgaaagagagttgcaacatcccgtccctcctataaccaagaaagaggctcaaggcctagaggcctcttagtattttggaggcaacgtattcctcattcaggtccaacccatttacaaagtgaactaaaaagctgcgagttttgagtggagcctagaaaagagaaggttctgcaaaaggcctacattactgtgcagctgctgtgccccttgagccacatgagccatcagatccaatggtacttgaagtgtcagtggcagggagaagtgctgtgtggagcctttggcaggcccttttaagtgaatcgcagtgcagacataggactctggagaaaggatctgccatcccctgtgaataactactgtctttctgaggaacagcttttggcctattcctgggcccttttagagcctgaacacctaatcctggtccatcaaattaccatgcaagctgagttggccattatgagctgggtattttcttacccaccaactcaagaggtagatgtgcacagtaacaatctatcgtcaaatggaagtagtatatgtaagattgagcttgagcaggccctaatggcacagttaagttacatgaagaaatgacacaaatgtccatgccttccatagaagcctgaacctatggcctcatggagagttccctatgatcaattgtagaggaaaagaatctcaagcctggtttacagatagttctgcagcatatgcagacactaccgaaaagtggacagctgcagcactgcgaccctctctggatcattcctgaagaacactgataaagaaaaaatcctctccatgggcaaaacttcaagcagcacacctggttgttcactttatttacaatgagaaatggccagcaatgagattctatactgatttatgagctgtggcaaatggtttggcttaatggtcatgtccttagaaggaacaatataggagtattggtgaaaacgaagtatggagaagaggtatgagagtagacctctttgaatgagagaaaaacatgaagatatctgtgtcccatgtgaatgcttaccaagattttagtaataaaatggatagaatgactcattctgtggatacagtcagtttctttccccatccacatttgtcatagtccaatgggctctttgccattgtggcaaagatggggattatgcatgggcttagcaacacggacttccactcaccaaggttgacctgactatggccactgttgaatgctcaatcagtcagcagaagaaacagcactgattacttgatacaggatcattcttcgagatgatcagtcagtaacctggggcaggttgattacattctattgcttccattatgggaaaagcagggttttgtttctactagacaaggcacttaccctgaatatgtattttccttccttgcatgcaatgcttctactaagactacaatctgtggacttacagaatgcattagtcactgttatgttattccacacagcattgttgctgatcaaggaactcacttcacaacaaacaaagtgcagcaacgggctcatgctcatggaattcattggcctttctatgttccccaccatgctacaaaagcaggcttggtaagatagtggaatggctctttgaagactcagtcacagagtcagctagatggcaataccttgcatggctgggacaaagttctccaaaaggctgaatatgctttaaatcagtgtctaatatatggttctgtttctcccatggccaaatgcataggtccaagaatcaaggggtagatatgggagtgacacaactcaccattacccctggtgaccactagcggaatgtttgcttcctgttcccatgactttatactctgctgggctaggggtcttagttccaaagggaggaatacttccaccaggaaacaaagtgattccattgaacctgaaggctgctgtcacctttctcagcacacaaatgatggggatgtaaggctggtgctcatggaattgcaattgcctcttgtctttaaaggcagttaatttctacccagtttctgagactgtggaaggaaagcagacaaggtctctgcttgactagtagattttgctcttccccaccctcaccataaagttcaaaggcacaaactgaaaagattttgaaagctggctcaaagcctttttcttctgttaacaaaaagttagagtattttgcttgggaggatcagtttcataattgtatcagtgctcctattctagaatttctagagccaattcttcagtaatgggcatctcaagcaagcacatgcaagttgtatgtttattaacaatttttttttaaactggcaatgcttctcatgttcccttacagagggaggaagacatatctggagagactgtggaaagagcagaagaaaacataaactgattacacccacagaacaattgctgatggaacatgaaggatgctttagggaaagcaccctgatgtttcacattcaaattgcctcatcatgtgtttttaaggtgctgcctgtctccaggcacagaggtgcctggaactaaaacctcagtgtttgtcctctctgtattatccttggctccagagcaaggagagagttccaggacaggtgtgtacagtgtttgcaggtgaatctgcatgttggtctgtgcactcgtttctcctttccaccccagcagtcagtggtgatttataagcatccttctgcatgcccttgtgatgtgagggaaagagcagaaacatttggtttagaaaataaatggagtctaagtaagaccttgagcctttagtgggttagttgtcagcttttggacagatccctttaccttcttacccttagctttctcccctatgaaacagggccatgatcttgtaaaaggatgaaaatgacatgagtaattgcaaataattataaacatcagggaaaattcaatctacatctactacgccttccattccttttcaactatgttatacatttcttttaactttagctattcatggtgcaagggatcttccagatctctagaaagctaattcaaagactgacattagaaaactttacagaaaaaaaaagattaaagagttgcaggcatgggtgcaaagagcaacatagctgctaaaggaagcttgaaatctttgtctagtcctggggacccagctggagttgtcaggaatcagcagagcaggtgttcagctgaggtttggaagaattcttagcccattgaaatactttatgggccgggcatgatggctcacacctgtaatcccagcactttgggaggccaaggtgggtggatcacgaggtcaggatgttgagaccatcctggctaacacgatgaaaccctgtcactactaaaaaatacaaaaaaattagctgggcatggtggcaggcacctgcagtcccagctacttggaaggctgaggcaggagaatggcgtgaacctgggaggcagagcttgccatgagccaagatcgtgccactgcactccagcctgggtgacagagcgagagtccgtctcaaaaaaacaaaacaaaacaataaaactttataaagtcctgatgcggtggcttatgcctgtaatcccagcattttgggaggccgaggtgggcagatcacttgaggtcaggagttcaagaccagcctggccaacatggcaagaccctgtctctactaaaaatacaaaagttagccgggcgtggtggtgggcacctgtaatcccagctacttgggaagctgaggcaggagaatcgggtgagcctgggaggtgaaggtggcagtgagctgagatcacaccactgccctccagcctgagcaataaagtgaaactctgtctcgaaaaaaaaaaaaaaaaaaaaaaaacttcataaaaatgctaaaatatttatccagaatgctcatttatttctaggatgaggtttatgcatttcatcatgcaaaaagttctgttcaggtcaggactagaacaaatattaatatatatttacaaatgtttgcaatgtacaaaaggctctgttagtgatctgctgtaaagaaaaagaaaggctgcatcagcctttgaagttttgtttgcctttgaagctggaggaagtcatattgcctgagtgctgctcttcacattaagaaggtagggccacttgagggacaccatctgacaggctgcaatctaggagagacctacagggttccaaaggctcagtgtgctaatttctgaaacaggatagaacctcccatcacctcagagcgatgggacggcaggcaggccttggcgagcctcacttcatctccaccctcttcatgaagcccctgacttttagttctctgcctaacagtccagaagggactggccatttccagctaaaggtcaggctgtcttaggcatagttgaagtaacagaatcatccttattgctggttgcttttttcacttttatttctttatttcctcttctcttgaggctttcagaggcacattttggtgagagaaaataagtctaaacatttatgaattagaaatattggcttctggcatccttgtgccagttgtgtgggaatctatttcttaataagatcataattaagagcacggttgcagattgtgactgtgtttacaggggccactgaacttggcctgtaaataacaaacaaagtcataaaaactatccagagaataaaaggtgcatcctacagtgaagccctaagagacagtagtccccaggctggctggagagcagcacagtagccactctgctgcagcgggaagggattgaggagatgtcacggagtctgagtggcagagccagggccagatccagcccatgaggtcacaggctgaggagtttctgagtttcagagccacaggcacagcccaaccccaggactgaaagatgccagttactcatccagtccccaaggagttcctgccgctgacctttgagagagaagaccccagggaacaagcctttcaccagaagggggaaactggagcttgagtagctgacattaaatactcatgttgtctttggttatagatttaatctccctgactctgtttatttttcgtttttgtctttcatcatgagtatgtggtcctaaagcagtgaatctcaaactatgtttctaaagcatctgaacctgctgggaaatgaaaagttacccactatttaatataaatatacatgcatatacacatacacatacaaatgcatgtacaaatacatatgcaaatacatgcacaagtgcatatacatgagcatgtatccacgcatatcatatacatgtacacatacacatacatacatatacacatatagacatatgcatatacatagacaaaagtatagctgttttggctgaagctccggtctcactcactcaactcacactcaccctctccctcgtctggccttcatagtgacacctaagcaccctcacaaaaagcctaggctctgcccaactccactttaaaaccactgagctttgattcagtcaaaagcttgtcctcaccaaccagcttgccagtgaatctgaaaatgtggacctttgcgtgagtcagtgctttctgacatcaaaatctcttgaaggaaagaggatcgttcccctattttaaagattgaatttggcaaaaaatttaaaaaaaagaagtaagaatttcaagccagatggaaaaaatctttagggctaaacaaaatctcataaaatgaatgaggaggaactaagcataaactatgtgatattaatgggttagagatgtgcagaagtttagggaagatattatacatgagcagagcatttagagattgatgggtttctggataagtggagggaagcagtgtaggaggaaaaagccatgggtaaaataaaagttcctgatgatcacagatgtcacaggactggaggagtttgtgctataaaagggagagggatcgtagttgagataatgagaagatgagagagactcgtaggagcctcattatggaatctacggagggctgataagggcagggctgatcctgtcactcagataggatgtagaacgctatctctgagtgggacaagaactctgccaggctggttcaggaccgggcgagtgagggtgaggtcttgctcagcattttcaatgagtgggccaatcagtggctctatgaaaatggcagagattccttccttggtccctgttggatagtcacctcgtaaaattgatcctaatttctgacaactactcatgaaatatgcctgcattttcccatgccaaacatttgcaaaccatctatttgaaaagtttaaatggatattgttaactgaaaaaaaaaaatccacaatttttaaatttagaaacggaaaggagacttttttcttataaagggttacatcctgcaaggtggccaacctgcaggctgggaagcatgcctctggctgaagcccggagacaggcactttgaaggagaaggggttgagttgtagaagcttcattctgaataggttgactaaacacacatattcaacaagttacaggaggagctgtgaatattcatgaaggtggtcctgacacatgcctagtgaacaaacatgcatgtaacatacaacccatattcaccttggggtggagagttaccatttaaatttgttacagtttagccctatatgtcaacaggttttatcaggagacaaaggcacttaagtgtgcaacctctgtaaaccagccagaaccagtccatgattggtgggctcttatcaggagaaagttactgaaatcagtctcttgtctgatcgaagctgtaactatggctggtggaacaggagtttagtgagtgagtgtctgtctgtgagctggatggattgtgattgttttaatattgcttacgttgaggctggggcttgtttagctgctagagaaaaagaaaaagctgtgagaacatagtttatcctttcagtgtaggggtgtgtgacttacctcttgcttggcatggtaggtcctgtttataatttggtatcttatggccacaaagagtctgttctgtcattcttacagtctctattttaacattaatgctggctgttgtgactaaaccgtaaaagggaaggggcataacaaggcatgtctgatgtcccatcctgtcatggccaggaactcagttttcaggtttctgtgggctctccttggccacaatggggtctgttcaataggtgggagagtctggattttatatttgtttatttagacagagtttcgctctgtcacctaggctggagtgcagtggcatgatctcggctcactgcaaccttcgcctccccagttcaagcaatcctcatgcctcagcctcccaagttgctgggactacaggtgtgagccacaacacctagctttttttttttttttttttttagtactttttagtatttttagtagaaatgagatttccccatgttggttaggctggtctcaaactcctgacctcaggtgatccacctgcctcggcctcccaaagtgttgggattacaggtgcgagccactgtgcccagcttggattttatttttagtttacaacatgcatgcccacacttgcacatatatgcacacatgtgtgcacacacatatttataagaagaaaatatggacagctgctacagtcttcatttctggccacagtatcgtagctaatatttaactcaactagttggggatcctttttcttgtcgggtgacccaaaccttaattcccaaagggtgtgagtccttagcagtcctgcctttgtgaggttgctattattgtccatttctatttccaaaggctgacaaaataaattaccacaaactgagtggtggctcaaaaaacaaattgattttgtcacagttctagaggctggaagtccaaaatcaagatgtcagcagaatgcattccttctggaggttctgaaagaaaagcctccctaggcccctctcctagctctgatgctgctggcacgtcctggtaattttttggcttgttgcttcatcattccagtatctgcctccattgtcacatggcactctttctgtgtgtgtctgtgtctcttctctgtttcctttttttttttttaagacggagtctcactgtctcccagggtggagtgcagtggtgcgatcttggctcacttcaagctctgcctcctgggtccacaccattcttctgcctcagcctcccgagtagctgggactacaggtgcccgccaccatgcctggctaattttttgtatttttaatagagacggggtttcactgtgttagccaggatggtctcgatctcctgacctcgtgatccgcccgcctcggtatcccaaagtgctgggattacaggcgtgagccaccgcgcccggccttctctgtttcttataaggacgatagtcacatggactagagcccacccttatccagctcatctacccttgatatcatttgcaaagactgtactcccaaataacatcacgttcacaggtattgggggttaggactttagcatagctttttcgggggacacaatctagcccacaaaattgtccactaacattttctattatgtgtggcagagccaagaagcactcaagagcatcccctgggtttttagggggacatggttcttcctacctcccttgtgagcagaaacccaatttctgcttagggatcagccaggacagttactctattctttatagtggaataagaagcctcaaatgacagaataaagcctcagtatcccattcaacagatacagccttattttctccagcagaagcacttctgtcttaggaactagaatctccaaaccagcaaagcacaagattctggagggagaagcaaaaatcctgcagaagaaatatgagaagagccatttccaattatgcctctttgatttccagactcctgtattctgttgattgattgctgcttcaaagcatatactacttccagaatgctgtcactttatgggcgctgtaactgagtattctcaggccattgtgccattatatcaggacaaggcagaaattggtggaggtcagtgttacaatctgcttgccctatcatgtggctgagtggttcccccgggaagttaatgctgctgaacccttgagtggcttctatcaccacttccttagccactttatacccagacccattgagcaaacaccccggagccttccagcacacccactgaatgtgtcatcacatccccctgattcctgaaagtctcctgtgtagcagatgaccttcagggaacattcacgtgggacacaggtatgccccaccctgtgtcccttctgagaagtccatttacacatctcttcttcagtctgtcactagttatccaatgccattctttcccagtctctgaccatctactcagagaaccacacatgaatttgtgtagatctgtacttctggccatctgttacgcagataaaatgaaaaactaaattttactgctacaagttttgtccactgggaagctatccttttccctttgttcttcagcactatccttgagtgagacagtagcattggcagcgatccacttatggctggtgccagcataacagaaccatctgcaaaccagctgccgtaggcaactcccaatgaggtcctaagtgtaaattatgggaagaaaagatggagaagaaggaaaagatggaatcggagtccttagcagtcacctgctcatgaaacctgtttctggacttgccgaatcttattctcctcccaccttatggcctagtgtgtcggtgcatagccaattcatgatgaacagtggtcatgaagttctcattttgtcttgacaaagctcagtagcatagcaagataagagttgattcttaaaataataattatatgcagagtagaacatggcttttctccaaagccctatatatttgcattgcgattctcatttgggcttgccagaagctcctgaaaacagatattcaattatgcttttatttatttatttatttatttatttatttatttatttatttattttgagacggagtctcgctctgtcacccaagctggaatgcagtggtgagatctcagctcactgcaacctctgcctcttgtgttcaagcaattctcctgcctcagcctcccgagtagctgggactacaggtgcccgccatcaggcctgattaatttgtgtatttttactagagatggggtttcactatattggccaggctggtctcgaactcctgaccttgtgatccgcctgcctcggcctcccaaagtgctgggattacagttgtaagccaccacacctggccttcaattatgcttttatgtgtgtccatatggccccagtcacttaccttggagctttgttggttactcaataaatgggttgggacagcactctcaaatgtggtatttgttgcctccaaagacattttctcaacaccgtgcccattttttaggggtaggtaatagatgaaataacaacttctgtttcactttggaagaaatgcccaaacatgcttcagaccacagggccatgagaaacctccccaaggcatgggcctcgagatttcatggggtttattgttcactctttgccacacatgtgtctcattaagacatttagggttcttgctgtgcttgctcaccagattcaaccaagatggtgtcctgggtatggtggaagaagatgttctctgggatgcagagatttccctgaacaagtccatcacagagagcaggagagtctggcctcttcagatgtgagccatcattaagttcaaattcactccaccatccatgcaaactgtgagagctgctccatggtgcccaaatcagcacattcagctagaatctctgtaagtgctctcacatggatggggtcagccttattcagtgttgaattctgtgctctgtggtgtaatgttcttaggattcatgcactacatttacccatgtttctggtactttgaattggtgagtattgccctttttatcatttttcttccctctctcttttttttctctcctataaaccatgtccttctggattggactttgcttttctccctgtggaacatacttgacatttgtgaccctaattatgggtctcatgcactaatgggtgatgggagtgagccctgagagttttagatatcaccttaccagggagctcaagcatgtgaagttattaaaaggtcttcaaataagggaagattctacaggcagggagaggaggctgcttccttcagcaaggatggcttagagagacttggggtgtaaatttcccagcttttcttgaatccacacagataacccaattccaagtcttggagagccccctgctacaatcaaagcctaacttttacacaaatgtattggcgagtctgaggattgaacttacactgtaattttgtacctactccattaaattctgcatctattttatacagctctatctgccttgctgcttgtaagtaaaacaaagatgttttgttttggttttagtgtcactggagaagctgtctgattctctgaacatgacgcaagccttgctgtcaccaccaccgtgaaggtcagatacagcacccaaggtacttgctgcaataggcctttcttcccctgcaactgaggtgataattgaatcataataccactgcacgccttgggttataggaatcccgtttcccactcagcattgcattcaagacaaaggacataccaagtcaaccctaacatctcacatcagatgttcataaacggctcacattttctgtactttatgcatatttttttactcataaaagagtcaaggggaaacagctttgaagaaggagcccaaatgatattagcgttcatgcttatttttagacttcaaaaagataggtatctaaacactacttactggataaatgtaagggtgtattttagcctttgtagatttcctaacagtaattattaactatacaaccatacgaactcattattaagtacttagtgtgcttttgacatcagctccatctcgatttctttgaattgcatgagctgttttgtaggacagtacacatctgtcctggaagtgtcccagagagccagcaaacccctcacctgctggactgtggctgtgttgggaacctgtctacgtttaaaactccaatgctttgactgagtggtattggctggataaaatctgtggtctttgtgagctctacaagggcaaagctggttaacttgttcatttcaaaggagtaatcttaatattgttaatgtggcttgtggcatcaaggttattagaatttaaggacttaatagatttctccatctactacatcaatggtaattgtagaaattagctaaaatgcactactgcttaaatgcaatggaaaaatatttctttcttcctttcaagactttaagaggtctgaaatgtttctgtccaggcccttgcgcctctgccaccgctgtgagaagtacatatcctggccagcctgctgactcaggaggttgagaatcaggtgcagcagaccagagcactgcttcagtgtcagggtagagctgctccatgacccagagattcatacgagtaagttattttcctcaagaccagtgagtttgttacacaacagaattgtggccatacccaaccaatacagcatgaatcttttccattacgttactatacaattacacaattgatcgttctatatgcattgttttgttaaactgcatgtcttagggatcctccaaggttagtacctataagccaaacttattctttttaatggctgcagagtattctgcagtatggttatagcaaaacttatttattcattcccctgtcgatgaatatctaacttcccaatctctccttaaatcaacaatgctgaaatgaacatttttatgtatatatgccttttcacacttgggcatcatatttaagatagattcctgctgtaaagtttatgaatcaaaatatgtacatatttaaattttgagaattactgccactttttctgaaaggctacacatttgcactcccaccaatgatgaatgagaacattgattaccctgcctcttctaaattaatcccagcctaatagatgaggaaaaagtctcatggttgtaacatactatttcttgatttttgagtaagtttaacacattttcatatgcttactatgtttgactcttccgagagagtatgttcatggtctaaatttttctattaaaatgtttttctttcttatcaattttaggatctctttatatattcttgatattcatccgtattgattaaatatgttacaaatattatctaccaatctaccacttgcccattgactttacagtgttttgctttttcactaaagaagattttaggtttttatgaagacaaacgtttcattagatttatgtaggacttttgatttttgcacattgcctagaaatacttgtacttcacttcaatataatgaaaccactccgtatattttcttttactaaatttacaatcttaacttttatctggcatttataccattgcactattatgaaaacactctataatgttttctcctaataagtttacagtaccattttatatctgaacattttttataatgtaagaaaaaatttttcctatagatatctaattatctccaaattatttattgaatgagctattcatttactattgactttaaacaccattatctttgtcataagctactatctcattaacagaagagtatattaatttttaaagagttttaaaaattttatagcaaaaacacataaaatttacatcttaattgtttttaatgtaccgtttagtagtattaagtacattcacattgttgtgcaattgtgaccaccatctatctctagaaattctttaatttgcaaaactgaacatgtacccattaaaaaataactcatcatttcaccctcaaaagggtgaaaatcctggaaagcctggaaactgccagtgtactttctgtctccatgaatttgactactctatgtatctcatataagtaaaatcatgcagcattctttttatgaccagctctttcacttagcctagtggcttcaagattcatccatgttgtagcacgtgacaggatttccttccttttttaaggatgagtaatattaaggatatatttctaaaacctcgagcctgtttatctgttttatttttctactttggtacaatactacaatgttttaaatacaacagatcaatagtgataagaaaaagctggtatagttggatatttgtcccctccagatctcacgctgaatttgatctccagcgttggaggtggaggctagtggaaggtgcttgggtcacgagggcagatcccttgtaaatggcttggtgatatctgcttggcagtgagtgagatctttttctaatagttcatgagagagttggttgattaaaagagcctgagctccccttccctctctcaccctctctctcgccctctctctcaccctctctctcgctctctctctcaccctctctcaccctctctctcaccctctctcactctctctctcaccctccctctcgctctctctctcgccctctctctcgccctctctctcgctctgctctctctctcaccctctctctcgctctctctctcaccctctctctcgctctctctctcaccctctctctcgctctctctctcgctctctcgccctctctctcaccctctctcaccctctctctcgctctctctctcaccctctctcgctctctctctcaccacaacataaacctgctccccttcaccttccactggtggtggaagcagcctgaagccctcaccagaagcaaatgctgacaccatgcttcttgtacagcctacagaaccatgagccaaagaaactgcttttctttataaattacccagccctaggtattcctttatgggaacacaaaatggaatgaaatacaagtaaatttgccatcttatcgttctctttgtaaaaatgaattagacattctccactgctgtggtctgaatatgtcccccaaaattcatatgttgtaaacgtaatgcccaatacaacagtgttgggacatggggcattttgagagatgtttaggtttcttcaaattgatatcattataaaagggcttgaaggagaaagtctggccccatttcacccttccttcctgatatggtttggctgtgtccccacctgaatctcatctcgaattcccatatattgtgaaagggaaccggtggaggtaattgactcatggaggcagatcttttccgtgctgttctcgtgatagtgaataagtctcacgagatctgatggttttaaaaatgggagtctccctgcaaaagctctcttctcttgtctgctgccatgtgagacatgcatttcactttctgctgtaattgtgaggcctccccagccatgtgaaactgtaagtcgaataaccccctttcttttgtaaattgcccagtctcggatatgcctttgtcagcagcatgaaaacggactaataatacacttttcttctgctatatgaggacacagcatttgtcccttctggaagatgcagcatccaaggcaccaccttggaagcagagaatagccgttacccgatagttaagccagccagcacctcagttggacttaggctgtagaacggtcagagataaatttctgtcctgtattaattacctagtctcagatattcagttatagcagcacaaaactgactaaaacatctgccatatgaattttaaaaaccttttatcaagttcataaaactttcagttaaattgaaaattttctttttttgggggggtttattattatttttattttttattatactttacgttttagggtacatgtgcacaatgtgcaggttagttacacatgtatacatgtgccatgttggtgtgctgcacccagtaactcgtcatttaacattaggtatacctccaaatgctatccctcccccctacccctaccccacaacaggccccggtgtgtgatgttccccttcctgtgtccatgtgttctcattgttcaattcccacctgtgagtgagaacatgtggtgtttggttttttgtccttgtaatagtttgctgagaatgatagtttccagcttcatccatgtccctacaaaggacatgaaatcatcattttttatggctgcgtagtattccctggtgtatatgtgccacattttcttaatccagtctatcattgttggacatttggattggttccaagtctttgctattgtgaatagtgctgcaataaacatatgtgtgcatgtgtctttatagcagcatgatttataatcctttgggtatatacccagtaatgggatggctgggtcaaatggtatttctagttctagatctctgaggaatcgccacactgacttccacaatggttgaactggtttacagtcccaccaacagtgtaaaagtgttcctatttctccacagcctctccagcacctgttgtttcctgactttttaatgatcgccattctaactggtgtgagatggtacctcattgtggttttgatttgcatttctctgatggccagtgatggtgagcattttttcatgtgtcttttggctgcataaatgtcttcttttgagaagtgtctgttcatatcctttgcccactttttgatggggtggtttgtttggttttttttgtaaatttgttggagttcattgtagattctggatattagccctttgtcagatgaggagattgcaaaaattttctcccattctgtaggttgcgtattcgctctgacggtactttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctgacatttaagtctttaatccatcttgaattaatttttgtataagggttaaggaagggatccagtttttcatgagatgtatagattaacctggagataatttacattttccatgactgtatctttcagtgtaggtatagggtatgtctcctcttattttttttttttaacattcttcaacaaagtttacaattttattcacatcagacttgtatactctttgtcaggtttatggtagaatttgctggcaactcttcaaaatttaatcaacccttttctttgtgcaagcagttagattcccttcccagcttcccttgcaattagttggggtcatatgactgaggttgtagttagtggaatttgagcagaagtgatggatgttacttccaagccaggaccttaaaaccatcccacactttctctaagctctctttccttcctgccttggatgacaactcccagggtgatcttgggagaaacctgtggaaggtgacagaacccctgtgtccctgaatgatgcagtggagcagagtcccaacctccccctctggactgctgccctgggcttttggatgagtgaaacatgaactgctcttggatggagttgttacacgtttgagtctgttactacagctgattctaccctaatcagtatcaaaccagtgaccttaaggtgtgatgccacagatgagccctgaaatacatgaatgccacttccaggccaccccataacaaccttacatacacactcttccatgctttcctcctctctggctaaccaggattgcaactccatgatagccttggaagcagggtataaaagatggcagagtcgctgctcacctgtgcacccagagcctccacacctgcctggaaccacctggaacgtcacgttgctaagggagttgttagatattggggtctctgtaatgctagaagaggttccatttagataataaaagttcttctttggggttttgtgtgcatttaaacaattggtaatggcatttgtttctttctatcatgttttctaattggttattgttagtatttttaaatgtttattttatatcagaccaccttactagttaatatagtttatcagttaattctgtgaaattttggggtagattatcagataaaactttttaaaatggcagttttgtcttttcttcatgctgtctgtacaatgtttctgtatttactgctaagatttcttattcactgtttgcataaaagtggtgctagtaggtgtccttttcttgtgtataattttaacatgaatatttatgatattttgccattagctattatgtttgctccagttttctagatctctcttatacaaaattaagaaagttttcttttatttctaacttcactgttttgctttgtttacatttttatcagaaatgtaatcaggatgttggttttagcaaatgctttcttgatattgattgagatgatcttgttttcctcttttaatctgaagacatacagaattgaattaatagattttgaaactattgaatcatgtttgcatatctaagtcttgattttacaagacacacacatttttaaaaatcattattctgtgaaatttgctaagattttttggggtttaatttctgcagctctctgtgttagtgagattggctgatctcatttagttttgtgtcagctttgtctagttgtggtgttagttttatactagcctcacagaataaggtagcagccttcccatattgtttgatgctacagcaaagtctgtatcacacagggataatctaatctatgagctaaagtttcataaaatttattaactcaagaaaatccctgaacttggtttcattattatggatagatttttttctttttattatcttttaaatttggtttagatgcttttgactgtttgaattttgtttcttattaagttaaaaatgataatttatagtgttctcaaaaactgtccatttaatctagacattgaaatatattaatttaatatcttatattttaaatatatttatatatttataccagcttgcttttaaaattatatttgtatttatattatattacaaaatatttttaaatgctcttttcattgcaaagaactgtctttttattttagtgatgaaatctgtgaattttagctgctaaatcattttgtttaaatcttattatattgcttctactttctttaggttgttttttctttgatttgattacatttttcaattatggaaaattttcagctgttagctccaaatacctcctctccattctttctctcctagaactcttacagattgtgcattctatcattaattcctcctaaatgatcattcccagtcgccattttttatatatctgctgtaatctgagtgatttctcagtgctaatgtctacctcactgattctctctgttgctatttctatgtaatctgttgaaaactgcatctattgataaattattttcttttttgctatcctttcattctttacttttagtttatttgttttatggaaggaaatatggcttgtatcatttttgcttttaggaatgtgcatagcttttctttgcagccagacacataatctatttttgtgcctatctgggtagggaggatttcaaaaacacctggaggcaagaatagggaacattaactgccttaaaaccaggatcagtcctggctccccaggggctcagctcattggctccagacaagagttctgatctgaacatctgagttaagaaaaaagacctcatgtgtcttcctgtgccatcctgctggagcaagagccaggagacctacaggagcgctgcttcctcctcccttttatgcgcttgtctcaagtctgttttggaggccattgcaaaggtgctgcctgcaggagccagccctctgggcgtgtggagggaagggcacactgactaagctgcccacaggagggaagtgggaccaaggacgtgggaggaagctcacatggtaactatggggcataaggcattttgagaaaagcaagactttgaggaggaatttttaggactaaagaatagcatgagtgtctggaaatcctagggtaaagagcaactcataaggagaaagagaaaggtgggagagctcagaggcaaaagtctattcttacctgtgccctggactggcccttccctaccccatttcctagacaccgagatagaatttcatgctgctcacagtgtccggactgcaacacaccatttctgtgtttcctgtagttaggtggagttgataatttaagtaacagacaaaactaagagaccccttggccagtctcaggcagcaagcacagtgtgtgccctttattattttattttatttatttatattttttgagacagagtctcactgtgtcgcccaggctggagtgcgatggcgggatctcggctcactgcaagctctgcctcccgggttcacgccattctcctgcctcagcctcttgagtagctaggactacaggcgcctgccaccatgccgggctaattttttttttttttttttttttttttttttttttagtagagacagagtttcaccgtgttagccaggatggtctcgatctcctgatcccccctcctcagcctccaaaagtgctgggattacaggcgtgagccaccacgcctggccgtgtgtgccctttatactagtaataggcacatgtgaattttgtccacacttatgcagaaatggagaaagaagcactgcagtaaacacctaagaaacagcaatcagaaaggttgtgggcaaagctcgatattcagatgtgtcctggactcccctccagtatcattttaattacaaatcatccatatggaaacctggagactgttttaactttccttttcagtttttagttatatcttacatcttatatcactttctaaaattgaataacctggagattaatttatttgcttgtcacttttccattagaagcttgaattcatttctgttttcattaccagtacacagtggcttgtcccaaattatcttcacccaaatcctacctggatgaacttacagcattttaataaaaatggttatttgctctgggagaaaattgtaatgggcaaaataaatctccttatctttgaagtagtttgaatgtgagatcacagtatgtcctttctgttaatacttggctgcaggataatccatgattccttctttaaaaaagttcagtactaaagttgttatgcaacattttattaaaagataaagtgctcccattcttcatatatactccataaactgctgagatgtcaaagtgctccataaataatacaagcttcttgcccatcattaacaaaagacgctgctaagtggacagaaaattcagtaattcccttttatggagatcacagtacatacacttagtccaatttgctgaccctgccatcaaaaattactgtctgcagaaaccctggcctggattttttcacactgaaaaatggagagctggggattttaatggaagacgctgaacactggttaaaattctgccttcacttgagaactggtccactgagaaaaaattataactattgcttcccttccattgagaacacactcttctatcaaaggcattctgagccaggaatctgagctctttcaagaaatcagcttatagtaaggccaaatgaactgctaagtcagatcccagtgtgatgatacgcatattcccatttatgatatgtcatcaatcatggctcatgcctcttgattgcactatgataaatatgccactcaagcaggttcatcgtacatcagagccagggaaggcagcttgggaaatgcacagggtaatgggcaacttggaaagtgtgcaaatccagacaaggcaggtgcctgcaggacaaatcagccaaagccaaccagatgtctgggcacctggtgtggacatgctttccctcagcccagatttagtttcagtgcatcacgtctctgtgttccaagcagcagttaacctcaaggccgcactaacatctctggtgagtttacggcctctggttcctatctactctctgatttaggatattcttcagcagcagattgatcctacattctggcaagtgcagttacatggatcgtaatgtgcaagttcccatgacccctcagtctttctttccagctgatgcacaagttagactctagtcctctccagatgtttcatctcacaatatgaaatccacctttcactggtatctctcacacaaatcagagccagattgccaaacttcttcacctgacctaatcggccaaaaaccagaaagcagtatttgctgttttccaatgatgtggcccaccgtgattaacttccataacacacaaacatgttcctcaaaaagaaaggctaatgctacattctagagaaaatgtattaccccttgatatggtttgactctgtgtcctcacccaaatctcatctcaaattgtaatccccacgtgtcgagggagggaggtgattggatcacttccaatgctgttcttgtgatagtgagtgagttctcatgagatctgattttaaaaatggcagtttcccctgtgctctctctctcttgctgccttgtgaagaaggtgcttacttcccctttgccttctgcataattgtaagtttcctgaggcctccccagccatgtggaacggtgagtcaattaaacccctttcgtttataaattacccagtctcaggtaatatgtttacagcagtgtgagaaaggacaaatgcacccctctcaccctttctttcctgttaaattgtttcaaaactagctttggggcatgttaaaaatgtagatgcgccaggcggataactcatacctgtaatcccagcactttgggagggtgaatcacgaggtcaggagatcgagaccatcctggctaacacagtgaaaccccgtctgtattaaaaatacaaaaagttagccgggtatggtagcatgcacctgtacagtcccagctactcggggggctgaggtgggagaatcacttgaacctagaggcagaggtttcagtgagctgagatcgcaccactgtactccagcctgggcaatggagcaagattccatctcaaaaaaaaaaaaaacaaaaaacaaacaaacaaacaaacaaaaaaaacctgcctgggcctcaagtgcagacctattaaattaaaatttctgggaatggggcttacagactcttgtttttttataagcagccagatagttctgtgcattgaagtttgagaagttatttggggtaggttttctctgagatgcctttctgccctgatattttgtggttctagaagcattcaaagaaaactgtcaatgcacaccccaaaggcacacccatgggtctcctgcagcactggccaccattctcagaccattgcaggactgtgcagagggagtgatggacaggggaaaatgggacagggaagagctaagggttggaaatcacaggtctgctttaaacttcagtgcctttacttctggctctgctgtcttagagcaattacatgacctcactaatttcaggttttctaatttccaagacctgcagtgttagatcagttacatgacctcactatttcaggttttctactttcaaaataggagtaaaaacagatacttcccagatggcaggagggtcaaatgaagcaataatggggctgtatatagcagtgtttaactaaaatttgaattatttaactctgtaaatgttagttttcttcccaatttcccgtttgtaaatgatccctggttcgtgggttattttgaagatcaccttagatgtatatgagagagactctctatggatgacgtcgtgaagagcagagaccctgaatccctttacctgtcggggaagagggacagacaaggccaccagttcaatctgagaaaagggcagtgtggtccactgaatagtggccccccaggacctccaccatctggtccctggaacctgtgatatggtgacttggaaggcaaaagggattctgcagatgtgattaagaactttgagttggggagattatcttgggccatccaggcgggccctaaatgtaatcataaattttcctataagagaaaggcacaggggacttgatgacagtagggaaaggcagtgtgatgacacagtcggggggaaggtgatgtgatgcaaggaaggggccaggagccacgggacgcaggcggctctggaagctgaaaaggcaaggaagcgattctccctagagcctcagttagaaccagccctgccctgcagacacctcggttttgttcccataagactcagtttagacttctgaccaccagaactatacattcccactgtttgaagccaccgagttcgtggtaacttttacagtagccacaggagaggaatgcacgtatatgtaaaagcaacactattgctaagaaagtaaggagcacgttttcataatttacagatgacaagtatctgaaatttcaagggtagtttgaactcacatatttcccccaccagcactttcagggcactcactcagtgcctggccttgtgcagctccgtatcactctgacaacctaaagtttaggctgctgcagccactttgccccacctgaagcatctcaggggtgggggcttgggatgctaaattcttctccatgctgcaggcccagggtgcactcaagctggcaccgtgttccccagagctggtctcagtatctccagagtgggcgtcctggaatcctctcagcctgggaggttctcagggtggctcgagcagccctgtcctcccagagcctgctcaggtcaggagacccatggagggaagggtagggactttcctcccaatccctagaagtcactccacccactatcccaaccttgcttccttttggccccatttgtcctcttgtcctcactttgtctgccagaatcatacttccgacctattgtaaagggtggttttgcagtaaaaatgaagctgatgcaaccagttcaatgcacagaggcccctgagctaagaataggatgagtgtgtaatttctcatccacaccaggacactgctgggcttggcaagctcccactaaagacagcacagtcacgaaccacaggactcaggccagggcagggaaagtaagaggaggcaggcccctctgtcaacctccatcttcccttatccgcaactggtgctgcaggcctgcagctgcagtaggcttccaggagagcccttcagaagacctaagggctgagcagagtcctccgggtggagaagcaggacacaggccttttatttcccttttcttccagaacaccacctggattagagagagccacctttcccaggtggggcatttgcctcctttgactggcccagactcatgattattcaaggctcttgcctgtaactagatcttcctaaggaatcagtgactctctagaacccatcagcagaggatcttctgccatgtacactgttatcacatctcttttagccatccatgaagtttctattttccaagagagatgcccaaagcctccaagccacttgcagggcagtcaggaatcacacactttggatcctattacagagcaagccttccttaatgcagaacacccctttcccctgcccagcttttcgggttcttttgtgatgaccttcccactctacctcctctcaggtgggcagataacactggatacgcagtgacaattttgaatttcaaataaacaacttaagttttttagtttctttctttttaaaaaatacctattgccctaccttttcccaagcccctccaccaaatctgaagaacacagtttccagaaccctatcacaattttatcatatcaaaaatacacacttaaaggctttttaaatttattgacgtgtgaagtagttaaagtggcaattatataattacacaataatttggtggagatgatatttcaaattataagatgcataaaggaaaggtaataaaagggtcttaggctaaaggccttcaaatttgtgatatacaaagagcacagaccacaaccatgaagtccaggagggccgggtcttgcacttgtagaaagtgcacaatcaggctgggcgtggtggctcacacctttgggagactgaggtgggcagatcacctgaggtcaggagtttgagaccagcctggccaacatggtgaaaccccatctgtactaaaagtacaaaaaatttgctgggcgtggtggtgggcacctgaaatcccagctactcaggaggctgaggcaggagaatcatttgaacctgggaggcagaggttgcagtgagccgagatcacgccactatgctccagcctgggtgacagagtgagactctgtctcaaaaagaaagaaagaaaggaagtgcacgttcagatgatgtctcctcccggcctcacactctcaggaaggaaaaacagaacagctgcgtagatcccacggtctcttcctgaagcttccctaactctagcaccagttccagatgggacagcccgtaggctgctcaggcagtgtgtcaaaggctcacctgatgtgccaaggctttctggcttggaagcccctttccgtgccattttgttaaaaatctgtaaacagaaatttaaagtaaattttacctatttattattttgttttatgctaatatgcatgtgaagttaacaattttggggccgttctatgaacataccagtggtaaatacccattataatgtctctttctgttttctgaaaaatgttctttcaatgcagataaatagtcattgaaaatcagtagaatgtgtgtcttttggtcaaacagcaggagagctgggaagggaagttgaaaggcctgggtaattttcatttgtcagtagtgaaatcatcagattaatgaatgaagaatgcatgatttccaccttcatgaagtcactgctagtcttaaccagacaccataaaaaaatgcaaggatgtcctgagctggaaagttaaaatcctgagtgttccagaatcatagactttaaatcctaaggtttaatcctgacattatgccatcaggagcctggtggccaggtaaggtggaaaatgtaaactattttaccaatttcaaaagagctctggaaattagcctatgaatcctataagtgaaaacgtcctccagccaaagacctcaggatcaggcctatagttgaacgagttggatttactatttgttggagggagagagactacacgcagggcacaccagcgggaactgtggggtgtctcaggcagagggggtttgccaggactcattacagaactggggcatgttgggtgatctggggagagcgttcaaggaagtggggctttgctccagatttggttggtgtttggaagaaggggatgctatgcgatgcgtgggttaatcttacctggaagaaggcagaccagagccaggcagcaggcttttaactataaagcagcagcactcactagcatgagctgggagagggggatattaagtcacttttatggtttgaaccatgttcttgccttgtctgtgttcagacctaatgacataatggtcttgttctttttttttttttttttttgagacagagtctcgctctgtcacccaagctggagtgcagtagcatgatctcggctcactgcaagctccacctcccaggttcacgccattctcctgcctcagcctcccaagtagctgggactacaggcacccgccaccgcgcccgactaatttttttgtaattttagtagagacggggtttcaccatgttagctaggatggtctcgatcgcctgaccttgtgatccacccgcctcggcctcccaaagtgctgggattacaggtgtgaaccaccgcgcctggccagtcttgttcttgtcttattccgtcacactcaccaagtggcttccctgaccgttcctgttcagtgaactgtttatgttcatcaggagagaccaaggcccagctgtgggcaccgggccagctcctgcatattaggggccacctttgtcttcttagagcaataataactgatgaacaccaggactaagttagcactgtgtgttcttgtttactgtgggattttactgaataatatttcattacatttctttctccagaaatgctgggaaggaataatttggtggagacaatagttcaaattataggatgcataaaggaaaggtaataaaagggtcttgggctaaaggcattcaggtctcgccgtattcaagtgtgcaatgatgtgttgtagccactgagccaaatcctgggagaccacaagaggctgattgtgtctgtccccatcagtatccaggaaactcactttccccaaacacacctacagcgaggtagttccctaagttaggcagcctctatccacaagccgcacctgcatctctccagtacctgaacacttccttcattccacaagcatttccagacagcccaccttcccctcacactgcatccttctcctcagggacacagaaaccccctctcactgctggtcccaattagatgggcaggcccctccctgctgctcaaagcacaaccagaaaccaggctcagaggcaaccagaactccgaaaggtgttcagaggaaggcgggctggttttgggaccccagggggagaaggaaggcacagcaacagggtgctttatggccccaagaccaacagaaggtgaccccagcctagcacccatggcagccagctaggcttgctcccgctctgatggaacagggccctctggcaataccaggccagcctgacgccacctgacggaggagggacctgaagccctgtccgcataagtggccccagggtggctcccctccttgtgtactgacagcccctcctccccacccagaaatatctggttggtgggcacctgcaggggatccaagcctcttcttcagacagcctgagccttgggccccactgggagacactcagggcagagcctggggaaactccgtctgcccctcagcctgcatcaggagggatcctgagagccacaaggacccccgagaaaccaagcaggagagaacaacacagcagcgactctggaaattagatgccagtagaaccacagcctgcaagatgggccaggacccatgtgccaaacctaaacaggtcactgccttctaaagcaaaagagtcacaggggacccaggtcacctaacatgacaggcagaacgtccaccaaacaactgaaaactcaccatccttccaagagtgcagagatcaccaccagcatgagcaccacgatcagctgctgccaagacccaactatcagatgttggaattatctgacaagggctctaaagtatctgccattaaaaatgcttcagcaatgacaggttctctcgaaataaatcaaacaatggaaaatctcagccctttcctcactgccccagggctggcaatcacttgacatggttgcctgttacacctgatagccctctttgacttcttttttttttttttttatactttaagttttagggtacatgtgacaatgtgcaggttagttacatatgtatacacgtgacatgctggtgtgctgcacccactaactcgtcatctagcattaggtatatctcccaatgctatccctcccccctccccccaccccacaacagtccccagagtgtgatgttccccttcctgtgtccatgtgttattgttcaattcccacctatgagtgagaatatgcagtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaatagtgccacaataaacatatgtgtgcgtgtgtctttatagcagcatgatttatagtcctttgggtatatacccagtaatgggattgctgggtcaaatggtatttctagttctagatctctgaggaatcaccacactgacttccacaatggctgaactggtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagactgtctgttcatgtcctttgcccactttttgatggggttgtttttttcttgtaaatttgttggagttcattgtagattctggatattagccctttgtcagatgagtaggttgcgaaaattttctcccatattgtgggttgcctgttcactctaatggtagtttcttttgctgtgcagaagctctttagtttaattagatcccatttgtctattttggcttttgttgccattgcttttggtgttttagacatgaagtccttgcctgtgcctatgtcctgaatggtaatgcctaggttttcttctagggtttttatgggtttaggtctaacgtttaagtctttaatgcatcttgaattgatttttgtataaggtataaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacctggcgatgcaggctcttttttggttccatatgaactttaaagtagttttttccaattctgtgaagaaagtcattggtagcttgatggggatggcattgaatctataaattaccttgggcagtgtggccattttcacgatattgattcttcctacccatgagcatggaatgttcttccatttgtttgtatcctcttttatttccttaagcagtggtttgtagttctccttgaagaggtccttcacgtcccttgtaaggtggattcctaggtattttattctctttgaagcaattgcgaatgggagttcactcatgatttggctctctgtttgtctgttattggtgtataagaatgcttgtgatttttgtacattgattttgtatcctgagactttgttgaagttgcttatcagcttaaggagatttttggctgagacaatggggttatctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattccgtttgccagtattttattgaggatttttgcatcgatgttcatcagggatattggtctaaaattctcttttttggttgtgtctctgcccggctttggtatcaggatgatgctggcctcataaaatgagttagggaggattccctctttttctattgattggaatagtttcagaaggaatggtatcagttcatccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgtcgaggaatttatccatttcttctagattttctagtttaattgcgtagaggtgcttgtagtattctctgatggtagtttgtatttctgtgggatcggtggtgatatcccctttatcattttttattgcgtctatttgattctctctttttttctttattagtcttgctagcggtctatcaattttgttgattctttcaaaaaaccagctcctggattcattaatgttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctgtacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtgctctgagagacagtttgttataatttctgttcttttacatttgctgaagagagctttacttccaaatatgtggtcaattttggaataggtgtggtgtggtgctgaaaaaaatgtatattctgttgatttggggtggagagttttgtagatgtctattaggtctgcttggtggagagctgagttgaattcctgggtatgcttgttgactttctgtctcgttgatctgtctaatgttgacagtggggtgttaaagtctcccattattaatgtgtgggagtctaagtctctttgtacgtcactcaggacttgctttatgaatctgggtgctcctgtattgggtgcatatatatttaggatagttagctcttcttgttgaattgatccctttaccattgtgtaatggccttctttgtctcttttgatctttgttggtttaaagtctgttttatcagagactaggattgcaacccctgcctttttttgttttccacttgcttggtagatcttcctccatccttttattttgagcctatgtgtgtctctgcatgtgaggtgggtttcctgaatacaacacactgatggatcttgactctttatccaatttgccagtctgtgtcttttaattggagcatttagtccatttacatttaaagttaatattgttatgtgtgaatttgatcctgtcattatgatgttagctggttattttgctcgttagttgatgcagtttcttcctagtctcgatggtctttacattttggcatgattttgcagcggctggtaccagttgttcctttccatgtttagtgcttccttcaggagctcttttagggcaggcctggtggtgacaaaatctctcagcatttgcttgtctgtaaaggattttatttctccttcacttatgaagcttagtttggctggatatgaaattctgggttgaaaattcttttctttgagaatgttgaatattggcccgcactctcttctggcttgcagtttctgccgagagatccgctgttagtctgatgggcttcgctttgtgggtaacccgacctttctctctggctgcccttaacattttttccttcatttcaactttggtgaatctgacaattatgtgtcttggaggtgctcttctcgaggagtatctttgtggtgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgttcatttctttttattcttttttctctaaacttcccttctcgcttcatttcattcatttcatcttccatcgctgataccctttcttccagttgattgcatcggctcctgaggcttctgcattcttcacgtaattctcgagtcttggctttcagctccatctgctcctttaagcagatgtattggttctgtattggttctctgtattggttattctagttatacattcgtctaaatttttttcaaagtttttaacttctttgccttcggtttgaatttcctcctgtagctcgtagtttgatcgtctgaagctttcttctcccaactcgtcaaagtcattctctgtccagctttgttccattgctggtgaggaactgcgatcctttggaggaggagaggtgctctgctttttagagtttcccgtttttctgctctgttttttccccatctttgtggttttatctacttttggtctttgatgatggtgatgtacagatgggttttggtgtggatgtcctttctgtttgttagctttccttctaacagacaggaccctcagctgcaggtctgttggagtttgctagaggtccactccagaccctgtttgcctgggtatcagcagcggtgtctgcagaacagtggttttcgtgaaccgcgaatgctgctgtctgatcgttcctctggaagttttgtctcagaggagtacccggccgtgtgaggtgtcagtctgcccctacttgggggtgcctcccagttaggctgctcgggggtcaggggtcagggacccacttgaggaggcagtctgcccgttctcagatctccagctgtgtgctgggagaaccactgctgtcctcaaagctgtcagacagggacatttaagtctgcagaggttactgctgtctttttgtttgtctgtgccctgcccccagaggtgtagcctacagaggcaggcaggcaggcctccttgagctgtggtgggctccacccaattggagcttcctggctgctttgtttacctaagcgagcctgggcaatggcgggcgcccctcccctagcctcgctgccgccttgcagtttgatctcagactgctgtgctagcaatcagcgagactctgtgggcgtaggaccctccaagccaggtgcaggatataatctcctggtgcgccgttttttaagcccgtcggaaaagcgcagtattcgggtgggagtgacccgattttccaggtgctgtctgtcacccctttctttgactaggaaagggaactccttgaccccttgtgcttcctgagtgaggcaatgcctcgccctgcttcggctcgcgcacggcgcactgcacccactgtcctgcgcccactgtctggcactccctagtgagatgaacccagtacctcagatggaaatgcagaaatcacctgtcttctgcgtcgctcacgctgggagctgtagaccggagctgttcctattcggccatcttggttccagaaaaaaagtctttgacttcttttaggggcgggtgcctttgcctgtgtaaccgctgttcataggaaagtgtccccattcacatgactccagtggtttctgccacccgtctgcaccgattgagtgactgaggggctctgcagcgctagcaaacattcacctggggagatagagaagatgctttagatcatactctcctggaaaatgccttgaaaccctctttcaacatttcttcctcctagtccttctgtcccaggctttgagcaggttattccctcatcagccacgtcctgtcggctgccattttccatctcatatctgacctataaatcacatcctacatctcaccttaagactggagggagatccagctcccactgccacacctggtcagcctcccagcatatgggactcaacaaagtttagggcagaagtggaaagaatatgctgtagctcccaattctttttccagaatctaaaaacaactgaattataccactctctggcccagagccttcagtcgcccctactgctcttagggaaagcactagggaatcccgaagacccccatctcccatcccagacagtgccttctcccaccctcactcctcctgcccaccgccaccctgcccaccctggccctctctggtgttcctctcatgcatacctctcaaggtgcaccaggcggctgcctctgggtacttgcccagccctgtcccctctgctcccctctcgcaggccatcccaccacactcgtcccacctggcttgtgtcaatgttccattactgttcaccggctgcccacgcacctccagctccacatcgtgagtatttctcccccttctcatctcatgtcctaaaagcattcaacaaatatgtactcagtaaacggtctctgctgctttccatgtgtaatgacccctccctaatgacctcaccagatgcctcctggacccactgccaaagcccctgtatttatttatttattttttgagacatggtctcgctctgttgcccaggctggagtgcaatggcacaatcttggctcacagcaacctccgcctcttgggttcaagtgattctcctgcctcagcctcccaagtagctgggattacagggatgcaccacaatgcctggctaatttttgtatttttagtagagatggggtttttctgtgttgtccaggctggtctcggactcctgacctcaggtgatctgcccgcctcagcctcccaaagtgatgggattacaggcgtgagccactgtgcccggcctagcccctgtgtttctgagctgtgctttttggtatttgggtcctggtaaatatcacttaggaagagacaactgacaatgtctttctaaactttcctttttctcaccagagaatgtgttgctagacgtcattgtcatggtggcaggaggaatttgttaaacttcaaaggaatgcctgtttgtcataaagcctttaaaacaagaagatggcatctcctatgtgggaggagtgaggtttgatcctgcggaaaataaacttagctgacattttcgagtgcgtcttgtgttctgggctgtccttgcgacagtgtcttggcaggtagtactatagtcactcctttaacgtggggacacccgagtttggataacgtgagcagtgtgctggaggtcagtcggcagggggcagagttggatttgaaggtgaggtcgtgtttgtggggccactgtttttaatcacggtactagaggcaccacagagagtgtagagaaaacagaaccgcaaggcctgagtgccttaaagagaggttttcagaatcaggacccagcatgcttattcttgctgcagtgccttaacacgctaaacagcgcttaaccacgctaaaacatcccatgggaaactgtgactgcaaggcccgggggatgttccttctcagcccatgccctgcccatgccccaagtaaaagcagttttagggaccactagtgtcccaggaatcatggtattaaagagttgttgggtgtggtggctcatgcctataatcccagctgctttggaggctgaggcaggagagtcgctggaacccaggaggcagaggctgcagtgagccgagatcgcgccattgcactccagcctggacaacaagagccaaactccaattcaaaaaaaaaaaaagttaacctttcaaagcaagatggttttagccataaattttcatagcaacagaggacagcacataccagtgacggaaccgatactttgaatcaagccagccagaggggtctacacccccttccactgcagacaccaaaacacagggtgccattctccattccctgccatttacaaagaagaatggacaaagtaagtttgaggttaacgaaagcagcctcaggatgttgagttcctagtctcagttcaaacagctatttgtgtgaggctgggcaagtcgctggggtgggcctcaatcccctcatctgattttacctgaggcgccaccaactctaggaagtctcccatgattgtctaaggctgggatccctccctgtgtggcccttactctctttttacctaattcccttcctaagaacgagctccttccagctaagataagctttctcatgactgcaccccctgtgtctggcagaggggacagcacctgacagatgcctgccttggaggctggggctgccacaacaaagaaccacagcctgggggcttaaacacagacgtgcatttcctcacagtgctggaggctggaagtccaagatcaaggtgggcaaggctggcttctcctgcagcctctctcttcggcttgtagatggctgtcttccctgtgcctcagacgatcacccctctgactgtgtctgtatcctaacctcatcttcttataaggacaccagtcagaatggattaaggttcaccctcatggcctgattttaactcaattacctctttaaaggccctctccaaataagatcacagtctgaggtacggtggttgggcttcaacatataaatttgaagaatcttaattcagaccacaacggggtctcacatgtctcaggtgaatggactgaatctcagcctgcagttcaatgggatcacatccatgtgaatctgaattgcagctgtgggttgacctcagccagttggctttggctctcctctgcccagttatttccaggagtctggaagaatctcaggagagctcagggaacctggaacaaacacctactgctggcccccactgctgccactcctgctccctcctgatggcagggtccctgtctcccccagtcacagacacgcggatgagcccccatctgcctggctgacccactgcctcctgagcccaagtctctttggctgaggccccagtacacaccaacaccattttcaaaatgactccttcacaatttctctttaaggccagacaccaaagtcccccagacctgtctctggaacaaatactcttatcttttgtacttgaactaacctttaaaaaaaaaaaagcttggaacctgatgccatagacgagctctgagcttctgtatatttggaaattctgaatctaattgaatagcatgaacttgtcttttccacaaaggatttgaggcactgtgtttttaagtgactaagcccacgtccctctccagacaccacctggggcttggcaatgaggatgctggcggggtttaatatggtcacatgggagccagagaaccaacaaggttgaccagggcacagggggcatgctgaagtatggctgggactgcagcaaattctaattccaagtggatggtaatttcttgagcattatgatgtttgaaaagtacaacagaagtctatattgtaatgtagtgccttcttatccacagggatatgttccaagacccacagtagatgcttgaaaccttgggtagtagtgaaccctacatatgttttttctctgatatatacatacctatgataaaatttaatgtataaattaggcacagtaagaaattaacagcacttactagcaataaaataggacaatcataaccatatgctgtaatgaaagttatgtgaatgtggtctctgtcacaaaacatcttattgtcttcgcctattttctgactgtggttgaccacagataactgaagccacagaaagaaacaccacaggacatgtgtggtggctcacgcctgtaatcccagcactttgggaggctgagctgggcagatcatctgaggtcaggagttcgagaccagcctggccaacatggtgaaaccccagctctactaaaaatataaaaattagctgggcgtggtagcaggcgcctgtagtcccagctacttgggaggctgaggcaggagaatggcgtgaacttgggaggcagagcttgcagtgagccgagatcgcgccactgcactccagcctgggtgacggagcaagactctgtctaaaaaaaaagaaaagaaagcaacgccacagatgggggtgactgtatggtaattaccaaaatgtgtaggagaaaaacatactcactttaaccctgacatattgatttcaccaagactatctttatcttaaatgacagcttaaaataatgtgtttgaaaaacaattacactattcatattaatacaaagatactaaatggcgaattcttggccgttttcatttaccacagaaagaaaagggggcaaatatagttggaaaaagattaaactctgtagcttcataaggtccttcaatgtaaagatgaatagcttcaacatgaagtgaaaagcatctgccacaatcttctaaaattactgggaatataatttaccagcagccttggtgctgagacataacacactctctctccattgttacccattgccctgaatatgtggtcagtgactatcaacgcgttgcgagtggaggaaggcaggatcagagatatcgctgcccaaaaaagcaacaatagcaaacagcagcagcaacacagaatgatggagcctcctgccacactcttcaaagcgctgcagccaggaggacacagagaagaaggtggtgtgggcctgcaaaggacagactctgaatcagtgcgacccaccccgcgtgtccctccaacccaaatagcggatccctctccccaccctacgctgccagtctcgagtgaggctcattgagaagggaagttgtaagttggagggaaaaagttttaagagagcccatgagtgcagaagtcccgcctcccactaaggatctcagcagatgcaggaaagtcacaggcaggaggtcttcaggtgtcttccctatgggcaggaaggaaaggggatgtgactataaccaaattcctgctcccaccagccctccaactaccagccctaacagccaaatccatggacattttatctgtcctgactggaggttgaagggtgtaaggagagaggttgggaaatttcaccgggagtacgcggctaactgagaaagctgaataagagttcactcaccccaaagacccagaatttcatgaattagagcaataaataatgatatagatctccttccagggtaatgcctaagatgtattggagcaccaacagaccaacatcaacagcaacaaagtaaagacaaaaacgcccaggctgtccatcctaggggctggccttcctctcagaaccccaggccaggaaagcaggaagaagggggagcacagagtctgaaaggggctgagacctgctttttcagaggaatttaaagatccacatggagctgcccaaattaagcaaaagtaagagtgaaataaatggcaaggcattcctgcaaatgtactgcaggggaacagtgaacacagggtggaccatggtctgtaaagaaagacaaagatttcattctgcagcaaaatatataactgaatccatgcaagaaagttctccaaaatgttgtgtaagaagttagtaagaaatcgatttcaataaaaaagagctaaaagatagaaaagcaaaatgaaaggtaaattgcagagttttggaaacaaattgaagagcaaaaactcatttcagaacgggaagaaaaaaaaaaaaacctacccgaactgtaaatagcaggaaacagaatagacaatgccaaaaataacaaagctaccatcatagaggaagaatttcagatctccaaagggaataagaggaataaaacacatcattgcatattcaagccaaaatgaggaaaaagaaggaaaattcattttgcataaataaatataccatgtatgtgatggtaggaaattaatttcagaaagtaaatgttataactcatgaatttgtaaaaataacaaagataattgcactatgaaaattaggtaaaagggaagatcaccacaaaatgaatgaattgcccatcctattaaacatctttcaattttctctcaatagtagtcaacagatactcttctgaattgataaatattaaagcatatcacagagtgttgtataaggaacctgcagaaaacctaaaaacaaaaagataactaataatatattggggtttgaagtgagaagtggagaattaatagaaactgtcaggttgataaatcatgaactataggttgaattatgtaaaattatataggtaaccacttaaacacataaaagcaataaatctttcattttaacaaaaggattgcacataatcagaaggaggggggaaataaaaaaatccaaaagggaatgcaaaagaaatattaattacagatattgaaaaaaatattaaaccaaatatatcagcaatatgtattaaaaatataagtgcagatccaagataaataaacctaaaacaaagtgcctcaaaaaggttaaacataaaattgagtataaaataataagaaatacatattggtctgtgtctccagtttctgacacagagctcctaatacccttgtaatttcctgagtgatgggggtactgggagcatcttttgttctaatattggttgggagcatctttgactgggttcctggtacagagcttccaatcccttggaatttcctgggtgataggagcatcttttgttctaatgaacgactcttggtggaatcctagatgagggctggtcaccagaaagaccaagccatggttagaagcttggaactttcagccccacaccccatcctctagggaggaaagaggagttggagattgaatcaataatcaatcatgcctacatgatgaagcctccttaaaaattcctaagtacaggtgcgggagcttcagggttggggaacacgtggtggtgctcctggagaggccatggcagctccatacccacccccaccatatcttttcctgtatttctctcccatttggctgtattctttataataagtggataaacatagtagtgttgccctgggttctctgcgctgttccaccaaatgactggacctaagaaggggggcgtgggaacctccgatttatagccaagttggacagaagctgtgggtgacctgcagacccaccacttacaactggcatctggagcagggcagtcctgggaattgagcccctcccctgtggggctggctctaactccagttagtgtcagagttgagctgaacggtaggacacccagctggtgctggcgaatgggtgggatttttccccacacatgtggagacgggaggtgttgtgtgagtgtaagaatgaacgagagaggcatctcagcataagaaatcagtggggctgattttaaaagcagacaaatgtgaattcaaggttaagtattgaaaatagaatgaaaatccggtaaatcgttaaacatcctgtggtaaatggaaggatgattgaaagaggaatgctgctgacagggagcgtggccccagccaggccagtgagcaaagccaggggtggaactcccacacacccgcccaggtcgttctcagagagggacccattcacaggcactgatcatacaaacccctcagaaacacctcagcacattataaatattagaaatagaacaaaaggcattttgcttaaagcataaggtaatgtaactagaaattaatttttaagttaaaaaatgtggaaattttaaaacactcaacaaagctcagttcgggctggtctgagtgcagtggggtgtacaaggaattgattacaagcagttacaggtttctttgctccttttccatttccactgctgcttcacttcactagcctttatttaaaaagtcagcttgaagaaggtacaacaattcaacttatagaatatccagaaaatacaaatgaaaacattgcatattaagacgtatggactgctgttaaagctttgatcagaataaaatgcagagccaaaaatacttatctgattaaataagaataattggaaacacatgaattaggcatctattgaataacttagaacaacaacaacaaaataaaagtagaagagaactggctgggcacggtggctcacgctggtagtcccagcactttgggaggctgaggcgggtagatcaactgaggtcaggagtttgagaccagcctggccaacatggtgcaacctctactaaaaatacaaaaaaaaaaaaaaaaaaaaaaaattaaccgggagtggtagtgggtgcctgtaatcccagctactcaggaggctaaggcaggagaattgcttgaactcgggaggtggaggttgcagtgagccaagatgacgccattgcactccagcctgggtgacagtgcgagacttcctctcaaaaaaaaaaaaaaaaaaaaagtaaaaggatcatggctgaatcctgaggatatcttatttcatgtaatgtgaaataagtcagtcacaaaaggacaaatactatatgaatccacttgtatcaggtacctagccaaatttataaagaccaaaaggaggccaggtgtggtggctcacgcctgtaattccagcactttgggaggaggaggcaggcagatcacttgaggccaggagtttgagaccagcctggccaacgtggtgaaaccccatctctactaaaaatatataaaattagctgggattggtggtgtgctctggtaatcccagcaactctggaggccgaggcatgagaatcgcttggacccaggaggcagaggttgcagtgagcagagattgcaccactgcactctagcctgggtgataaaatgagactctgtctcaaaaaaagaaaaaaaaaaaaaaaggaccaaaacaagagtggttgatgtttgatagagacagggtttcaatttgggaagatgaaaagagttctgggaatatgtggttgtgaagactgtacaacaatgtgactgtatttaatgacactgaatggtacacttaaaactggttaaaatgataaattttatgttatgtatattttacgaaaatttaaaaatatacaataatttttaaaaagtaaaatagaatgaaaatattaaagataaaagcagaaaactaaaaattagaaaacatacctgcagaatttgttgatgggaagtatttatcaaaggtgaacacacagaactctaacacagcagcagaggaaatggtaggaaggccattggcagaaaaaaaggaaatttagaaagcagtgcaaaatgttacacgtgacggtggagagaagacaagaaagagtgtggaactgcagcactgcagaaaggtggcattcccgaagcgggctgtgtgcaaacacagggggcgtctcgtcacaaagagtttgagaaagatagaatctgtgggccgcatccccaggggccataactttgagaccccttccccaactcaggacaagctatggcattagaaggtcaaacgcatatgaagtaaacagtaattacaaaaggagctatccatggtgaggtcagaaacactgatagacggaaggtctagggaggttgggaagggtttgtaccacataaaaaatgaaggaatgagaaaaagttaaattatgtaagagttccttcctgaggcgtgcacctccagggggctctgcttaaagcttctgtcagtcttttctccaactcactggggtccccgtgagtgcaatgaccagctacatctaacccaccatgctgccccgactagtttgtcccacaggctcccagggcccagaggaagggctgaaccgtgtgttgggcccagcactggctggagaagcacctgcaacaactgtggcttctgctgtgctggcccactgctgtcacctgggagggctgggtcaacgcagggacccccaagaccctgcagacaggtcctcggactgcaaagtctaagggtccgatgtcttaaaaatataaaccggtaaaactcatggcaagctaaatcaataggcacgggagaaaggagaaatgcacacaattacaaacggaaaaaggagaaaaagccacaaatacagaggaaagaaaacacctgaagtgcatatattacaaaactacgcaactatgttgaaaagtggatggaattaattttatttttaaaaatgtcattaaaatggactctagaagggctcgaggacctaacttgcctgatgagcaaaatccagaaatataccacggcaggcccagacagccccagctagttcttctacacttaagcagaaaataatccaaaaccaatagatgattgtagaatatagaggtttttgttttataatatttcttcctttaagtcagcataaagttaaatctggacaaaaaacacataaaagcaagatgtagaatgatgaatcttaattataaatattgataaccaaagtcatgatactaataagtaaagaacatctcaggaatacactaatgatttggtcttaagtattctattaatataattaaacatactactagagcaaaggaaaagaccttctgataatccctctggacactgagaaggctttgacaaaaatctaacatctacattttccccagagagtcttaatagtttgagaacacacagatacttttttattatggcaaggaaaatacatgtcttcatacaagttaaacgctgagacattaaaacgtcccactgatgtcacgaacaagataagcatgccacctgaatcactgtgactcaacactgatctcaaatcaactagatacaagaaagaaataagagacacattggaaaggagaagtcaaaagtataccttagaaacaagtaggaatcacaatttgtggttgattataacattcatacataaaaaccaactactttcttatacaatgggataaaatagaaaataaagtggaataaatcattccattgaaaatgatagccaaatgataaaacatctagaaataaactataaattcaaagcaccttagtgaacaaaatcataaaacactactaagttacataaaattagacttaaacacaagatttcatgcttttgaataggaagactcaatctgtaaattcattgtgactctaattgaaaaaagattcatatgagagagagattcagagttgatgggagtgttgacttgaaaatactgatattagtatgaataatgctttagaaatgaaaggcattcatagagataaatagaacagaaacagaaccaaacacttaaagaaatttagtttacaaataaggctgcattttgaacaactggggaaaacactatgactgtattttagaaatgcattattacatatttattgatactgctgaccaccatttcgaggaaaaagtatggatttttccctcatgtcctgcaacaaatgaattccagggagtctgaagatgtgaaggtaaaccaataaaaccataaagtttcagaagaaaatgcgagtaagtctatttataatctcagaatgaggaaggcttttaaaaactggaaacaaatcccacgatcgacaaagaaaaatactcacaaattgacaacataaaaatttaaactctatgccaataaataaggaaatcaataaataacatcgaaagacaaatgataaaaatattttaaagacataagacaaaaatgtcccaaagtgcatgagcaaattaagaaaaagccaaataacccaattaggaactgggtaaaatatataaatgtatcaaaattaaaactacaaaaaaattttaaaagatgtcccattttatacacaaaataaaccaaaatcagaataatattcgtaaatatcatgtttcaccaattatattgggaaaaacattaagtttgaaaatacccagtgctattatagaaagctgagaaattgggccttttattgtactcttgatggagttacatccttcgatcagtttctagaagataatctggcaatagctatcaaaattttaaatacatgtagccttaaacccagcaattccatttctaagttggaatttataccgttttagtcacaaaactatgtcaagatgtatgtacaagtatgccaattatagatttgtatataaaaataaaaactggaagtatccatatgttcaccaataaaaggctattcaaataaatgatagtccgctgagataatggaatgctaagcagctactaggaggaatgaggtagatctttatatgttattatgggacgacctctaagacaaaacaccacatgaagaatgcaaggtgcagcgcccttcacagagcgttagtgctggaaagggaaggtctctctccataacccccgtccctccttctttggcctcttatcttcttttcttcctttctagaaatgcccttagaagctcattagtggtcccctctgagagagaaaacaggcagtatgggagactgttgtttttaaccactcatacttttctaactatgtgcacatctattccttattattactttattaaaggacagagtagttatttgagagtccaaaatatgcacaacttgtttgcattttgtgttcctgtataaaatacaaaaccaaaaaggtttctttttaaagcaaaaatgtgggagggatcaattttgggataatgataagaaatga
